United States Patent 12,491,220 (COMPOSITIONS CONTAINING INDOLE-DERIVED METABOLITES AND METHODS OF USE THEREOF) - sequence listing, part 8

SEQ ID NO: 12 - DNA, 3976469 bp, unidentified (residues 1-1,988,235 of 3,976,469)
  source 1..3976469: mol_type = genomic DNA; note = Bacillus velezensis
gatagtttgactgactacgcacatcgctgtgcgatttatttaaaactttgaattaacaggtacgttttgtcttgtttagttttcaaatatcattaccgcttgttgaagcagctttattagcttaccactcagcttcttttatgtcaataactttttttaagttgtttccgaagcttttcgttgttgtctgctgttcatcagcgacgtttaataatataacacccttttgaaaatatgacaatagtttttttaaaaaaatcattaattattttctttcatacttatttcagtttctcttctatagaaagataagctgtcttgtggtttggtatattttcttgtatagtaagattgaactaaatacttgatgaccacaaggggagcattaaagctgagagtgaacgttttgttctgaccctttgaacctgttagttaacgctggcgtagggatgtggcaaagccaaatgatttgcagtttatgtaagcagcgcgcggaccttttcccatccttccccgcgctgcttttttgtttatccttgatacggttgtctgaccagggggaaaactatgaatcattcaacacagcttgtgcgcttaattgaaatagcgattatgaccggggcggctgtcattctggacattgtctcaggcatgtttctccggatgccccaagggggttcggtctctattatgatgattccgatttttttgatttcattccgctggggagtgaaggccgggcttacgacaggctttttaacagggattgtccagatcgccatcggcaatttgtttttgcagcacccggtgcagctatttcttgattatatcgcggcatttgcagttctcggtttcagcggcttgctcgcttccggtgtacgagcatcggcattgaataaaaaaagaggcgctttaacgatgtatgttataggcggtgttttcaccggcagtgtgctgcggtatgcggcgcatgtggtctccggagcagtctttttcggaagctatgctccgaagggtacgccggtctggatttattcatccgtctataacgcgacttacatgattccttcttttatcctttcggccattgtccttatcttattattcatgactgcgccgcggcttcttgaagctaagcggacgaactgaaacagcaggcggtttacgcctgctgtttttttattccgggctgtgccgttcgttagaatcactcagttcttttgtaagttcatttatgctttgttttatgtttcctttgcctgaaaaattctcaatcagctcttttacattgattccggaagatgcttttaagctttcctggagaccggccattaaattggttgcgtagcctgtgactttattggccccgccgttttcaccgcttcctcccgtatccacgacggtaattttatcaatgtttgaaagaggcgctgagacttgttttgcgtattcaggcagcattttcacaatcatatcaaggattgcagcctgcccgtatttttcgaatgcgtcggcgattttttctttagcttccgcttctgcgagacctttcaggcggatgacttccgcttcggtttctcctctcgccttttcagcctccgctttagcaagaccgtcaattctcacgcgttccgcttccgccttggccatcgcttcgatgctgtactgctcggcatcggcttcggcgagctgcttcgcttttgcggccgcggccgcttgttccaccgagtaacggtcagcatcggcttttttcttcacttcagagtcatattggcgctcacggcgcagaatttctttttcctccaattcaatctgcttttgccgctcaataattttaatttgcatttcctgctctgtcacctgctggcgcgcttttgcggtttcaagatcatatgcctggtcggcattggcttttgctgtatcctgctctcttctgtattccgccattttcagctgattgattttttccgcttcagctatttccgtcgcccgctccagctctgatttttttgcgtctttatcagcggccgcgcgtttaatcctcgtctctttatccgcttctgccgtggcaatgtccgcatcccgcttgacttgggcgattctcggcttgcctaatgattcaagatagccgtttttatcccggacgtctttaatcgtaaaagaaacgatcatcagccccattttagcaagatcctgagacgcgacccgctggacttcctgagaaaacttttccctgtttttataaatctcttcaacggtcatggagccgaggatggagcgcagatggccttccagcacttcccgcgcctcctgctcacggtcgtccttggatttccccaaaaattgttcagctgctgtggcgatttcaccgatggagcctccgattttaataatggcggttccgtcggccattaccggcaccccttgctctgtatagacttcaggtgtagagacatcaagtttgcttgacagtaaactgagaggttctgcctgctggaataccgggagcacgaacgttcccccgccccggacgattttcagacgatttccgccttcatcaatgtggacgttcttatttcccaaataacttccggtcacgataagggcttcgtccggccccgctgtccggtacttcgtaataaatacagcaataagtgcgatgagtaaaaagaatacgattccgataacaatgataatcggcatagtcataacagttcccccttagatatcagattggttcatgcggcgtcacaaaaagcactccgtctttcacgtcaatcactaatacggccgttccgtacctgatctgttcttgatcaaagctgacggctgatttagaaatggcgccccctattccctctatgatcacttccccatagccgtctttcgggacggaagtaatgaccctgccgaccctgccctttaaatccgtctcccgatatgcgagcgattcttccgctgatgaaagtgggacaaggacgaagaagtgaagcaggctgaccaaaagaaccgaaagaacaaatgaaagcaacgcaatgacaggacttgatagcggagcggcgatttcgccgatataacctgaggctgaaaagattgttaaaaaagacagaatcaatgcagggtttaaaaatgaaacaggaatggcttccgagaggccgtgaaacacatcttgaaaaaacagaatcaaaagcgtgagacttcccgaaataatcaatgtgtaaagatagaccgtttcaagcggcagatgaaatatgtccacattctatcctcctttcggctgaggtgtcggggtgttactttatatacggatgtaaaggtaaatggtttcaattttctgataaggaaggctgattacatgattatccaatccggatatgatatgtttactctaaaggaggagataggatgagcatttttaatgaagccagacagcagacctgggaagaactgaaaggactctctgatgaggaattcaaccgaaagcccgcggctgatgaatggagcgtgcgggaagtccttgaccatttaaagaaaattgacgaaacagcgcagacccttttatcaaagcaggcaaaagacgcaccgtttaaaaaaatcgaagacaaaccgatggagtttatagaggacagatcaaataaacggccggcgccgtcacacctcgaacctgagcaaaaccgaatctcagtcattgaggcaaaacaagaattagatacggcaagacagcagctgaccgcagttatttcatcattaaacgaggaagattttgaacgtgtgcttccgcatcccgtttttcaagaactgacgatccgccagtggattgattttatcggccatcatgaaaagcgtcacatcgatcaaatagaagaaatcaaacaaaaaatcgagaaggtctgagtcagaccttctcgatttttttcttggcgcgtttcggttcataggaatggatggtgaccgcatcgcccgtgcatatatcacccgggcgttcaacaatacagacaattcctcttctgcccatcgcgtgcctcacaaacgccgcggcgagttttggctgagccggataaaaggattgaatgacttctcccggctgaatgcacggatcattttctccctcgcacaacagagacgcaccgcttggaaaaatcattctgcttccttctttaagcggcgtcagcgcagaaaaaccgctgattgcgatgttagcgccgagccattcgggaaagatatgagaaatccccatcttctccgcaatgtcatcacattcctccatggacacgattgaaatttgtctccggttaaaaatttctgttcctctttcatacatcggctcacgcgcgccggccttttttgtcagtccgaaatgcaggtcaccgggaaacccgccgtattccgcgcgaagcttgtccatctttttggtaacaaattgttcggtatccgctatatatacgccttccgtctttgctgttatgcgtttccacatcagccaccaccgcctttttcttgacattatccttaaaaaaccccgctctgtaaaggagcggggttcatttattataccgttttcggcgttaagtcaaagcagcgtttgtaaatccagttgtatgctttctcattcaaatctcttggatttccgaaagtctgcggatctttcatggcttcttttgataaacgttcaatcatgtccggagacacaccttgttcttctaaactcggcacctctaaatcttttacaagatcatacatccagttgacggacgctttggccgcttcttcggttgtcatgttgcttgtatcgattccgaatgctttggcgatgcgggcgaatttttccggatagcctttccagttgtattccattaccggtcccatcatagctgcgacgcattgtccgtgagcgacagggatgatgccgccgagcgtctggctcatcgcatgcgccgcgcctgctgattcactgccgtatgaaaggccggcaagcatcgccgcctgcgccatgccgtatcttgcttccaaatcctctccgtccgcaaacgcgcgcttaatataatgcgccgcatattcaatggccattaaagcgacggcatcagtgatcggctgcgcgaatttcatcgtatagcactcgatggcgtgcgcaagtgcgtcaatacctgtcatggccgtcacatgcggaggcatggacgtgtgcagctcagggtcaatgaccgttaaatgcgcagcgataagcggtccgcccgtattgaatttaaattctctttcctcatctgtaatgaccgcccattgcgtgacctctgaacctgttcccgcagtcgtcgggatcgttgtcagcggaggaatgcggttttccagcggctttttgccttccgcggcttcataatcaagcacgcttccttcgtgtgtcgcttctaccccgatcgctttcgccgtatccatggagcttccgccgccgacagccacaagaccgttgcagttttcttttttatacagttctgatccttcgtttacaagacgtacaggcgggttcggctccactttgttaaacaggacgacttcgatgcccgcttcctgcaaagattcaatgaccgggtttgccactcccgcgttataaattcccgggtctgttacgagcagcgcttttgtgacgccaagcgctctgacttcacttcccgcgtgctgaatcgcgccgattccgtgtttaatgactgtcgggatttcgaatgtatggaatttatgcatgctttctactttcatatttaatgtcatattgtatctcctcctaattatgcttgaaaccagttcacagccgcaggtttcgtattgcggtaaatatgtttgatttccgtgtattcttccaggccgattttgccgagttcgcggccgaagcccgattgtttgtacccgccccatggcgcttgcgcgaaatacgggtggaaatcattgatccataccgttcccatccgcagtttggcggctacgcgttcgcatttttcaatatcctttgaccataccgctccggccagcccgtaaatggtatcgttggcaagtctgatcacttcttcttctgaagagaatgactcgactgttaaaacggggccgaagatctcctcttggactatccgcatatcagacttgcagtttgagaaaatagtaggttcatagaagaaaccgttttgaagggcgggatcatcaggacgtttgccgcctgtttccagttttgccccttcttcgataccgatttctacgtatttttcgactttggcccgatgctcggcggaaatcagcggaccgctttccgtatcttcatgaaaaccgtttcctaatttgatgcgtttcgtgcgcttgatcagctcggctaaaaattcatcatgaatggcttcgtccaccaaaagacgtgacccggccgaacaaacttgaccggcatgaaaaaacacggcgttcagcgcttgatctgcagctgtttcgagatctgcatcttgaaatacgatattcggatttttgccgccaagctccagggcaatctttttcacgttgccgcttgccgcctgcatgatttttttgcctgtttcaattccgcccgtaaaagagaccaaatcgacgtcgaggtttctcgccagctcgtcgccgacagaggcgcccggccccagcacgagattggcggcccctttcggaataccggcttcttctattaattgaaagactttaatggttgtaagcggagtaatctcgctcggctttaaaacgatcgtgtttccggccgcaagagcgggagcgattttccagctcgcctgaaggagcggatagttccacggcgtaatttgtccgcatacgccaattggctctctgacgattttacttacggaatcgggaatcggagatgaaatgacttcgcctccgtctttatccgccaaaccggcataatattgaaatacatttgcgatatcatccatatcggctttactttcttcaatcgtttttcctgtatcaagcgattccagctcagctaattcgttaagatcgcgtctgattaattccgcaattttcagaacaaattgtccgcgctcgagcccggaaagcaccggccattccccttcatcaaatgcttttctggctgcggcgatggctttcaccgcatcatcccggtctccttcgcataccgttgcaatttcttcttgattaaatggattaatgatgcggcgggtctgttttttttctgcactgatccattcgccgccgatataaagcgttttgctcataagagtcctccttaccgagaagtaagtttgttaaataaaaatttaatgtttttaacaatgttaatttaacacatgtttttttgcctgtcaaaacccggacagtccgtttagattttgacattttgtcatgattcgttaagattaagaacataaagaaatgacttaacaaatttaaacttcaagaggaaaagagggacagtatggatgagaatccagaattcgcagctatagaacaagccagggatcttgtcattgattccattgcagagacgatggatctttacggaatcacccggagtgtcgggattttatacggaacaatgtatatgagggatgaaatgacgcttgacgaaatgcgtgaggaactgcagatgagcaaaccgagtatgagcacgggcgttaaaaagctgcaggatttaaatgtggtcaaaaaaacctttcaccgcggcacacggaagcatacgtttgtagcggaaaaggatttctttacgtttttcacgaatttctttccgccgaaatgggaccgtgaagttcaggtgaatttgtccgccatcgtacaggctcaggcggatttgcagtccgttttgctggccgaggaaggcagcgcggaattacaggaagaagcgcggcagttatatgatcagcttgaaagctcgaaagcttattatcattggctgaagcggctcgccgactcggttcagagcggggagatttttaaatttattccgatagaaacggacgaaaaaaacgcctgattttgattcaggcgttttttgtcgtgatttgattatttttgagaaaatataggaacataaccccatttacttccattaaaattgatggtaaatttttataggtatggtcgttcttttttaagaacaatcagcaaattttttttagggggatttataaaaatgaaacacaagtttttctcaactgtcatggcaagtttattcggcctggttttgcttctttctctgccgacagcgtcattcgccgctgagtcaggctcaaccgttcacgagccggaaatgtccacgaaagcgactgctaccttatttgcaaaatatacaggtgccagccagcaggaatggtcattttctgatatcgaattgacataccgtccgaacacaatcctgagcttaggcgttatggaatttacccttcctagcggatttgcggctacaacaaaagatacagtcaacggacacgctttgcgtgaaagacagattctgaataacggcaaaacagtcagacttccgttaaacattgatttgctcggcgcagcggaatttaagctttctcttaataataaaacattgcctgctgcaggtacatataagttccgtgcagaaaataaatcattaagcatcggctctaaattctatgctgaggacacaattgttgttcaaaaacgcagcacaccgccgacacagccatgcaactgcaaataattgcgaaaaacggaccggcacaagctcatcgcttgtcagccggtctttttttgtgctgttttctttcttccggccctcgcattgacaaacccctgaaacaggagtacattcttgtttgttgtatttggagtgacgaaaacagtttcttaaggagttatgaggattgggaaaaatcaaaaataaacaatttgccgtcatcggactcggccgtttcggcggaagcatctgtaaagagctttttaaaatggggcatgaggtgcttgcgatcgatatcagcgaagagcgggtcaacgcatactcctcttatgccacgcatgccgtgcgggcaaattcaacggaagaaagcgagcttcagtcgctcggcatcagaaattttgaatatgtcatcgtagcaatcggagccaatatacaggcaagcacgctgacgacgctgttattgaaggagctgaacatccctaatatttgggtgaaagcgcaaaactattatcatcacaaagtgcttgaaaagatcggtgctgatcgtattatccatcctgaaaaggatatgggcgtgcggattgcgcaaagcctttcagatgaaaacgtcttaaattacatcgatttgtcagatgaatacagcattgtggagctttcagccactaaaaagctgcatttaaaatcccttcttgatctcggcgcacgcgccagattcggctgcaccattctcgccgtgaaacataatggagacattcagctgtccccttctccggagactgtcattcatgaatgtgactgccttgtgctgatggggcataaacgtgatattaaaaggtttgaaactgaaggaatgtaaaaaaagccggcaagctgccggctttttttgatgcttatgtttcttcacttaactggacggcggtttggtcaacccagccgaccagcttatctttcacttgaatttggtaccagacggattctccgttttgtttttcagatacgactttaatatgctggccggtaaacttttgcgccgatgccagtttaatagaatgccgctctttcgacggcttggaccacacgtcttcaatggcgtggtctttgatggcgcctttcttatcaactgctttaagagaggcattgattttgtcatattcattcaggttataggtttctatgacatctttaattttttcagcatagccggggtctgtggcgtagccggatttttgaagggcagccgccgctgttttataattgtccgcttcaatgacgggcttgtacttctttttattccaagacgttccgttgacaaataatttggcatggtcatccattgattcaaaaaacgtgctgtatttacggaattttgcccgaatcgtttttcgttttcctttttcaaattcatccgttttcatcgtgacgtgttttcctttataatcaccttttacaccgaacaggttgcgcgctttccccgcaagctcactgttcccccagtccgattcgagaatggcctgtgcgagggtgatgctcggaaggacatgatatttctcatataaaatttgagcatgcccggaaaggctgtcaataaagacctgctgctcgtccacctcttcaggcggtttttcttccgtcactatgaatttcgaaaataccattgataccagaaataatccgagtataagagatacagcaaaaaggcacccaagcacccttttggtctttgctttctttttcatatcaaccttcctttaattccggaatcactagatttataattttactggtcattgatgaaaatttcaataaaatagggaaaaagacggagaaagaacacattgtgcaaataaaaaagactcctcaatgaggagtctttttttgttatgccatgctcagctgagggccgaacaattcatattgaacggaatcagagtcaaacccgagtgcaagaatcatatctttcatttgcgtcataaactgcgctgatccgcacaagtaacattcagcatcttgattcagatgaagctgctccaagaaggtttgatcaatccggccgctgtaaaaaggcttgtctcctgagcggtcttgttctgccggttcactgtatacataaatgacgttaatattcggatgattctccgcagcttgttcagcctctttgcgaaacgcggcgtactctccgtttttcgcggcatgaataaaagtaacggaacgctccggctgtttttcggcggctgttttcagcatgctcatcatcggcgtgattccggaaccggcactgataagaacaaccggtttttcggaagaagacagcttgaaatccccggcgggtgcgctgacttcaagtttatctccctcttgaacttcattgtggagatgagaagaaaccgctccgtcctttttcacagatatccgatatgcgccttttcgagaagcatcagacaggctgtactggcgaatgtgcgtataaggagaatccgcaatcctcactttaatgctgatatattgtcccgcttcaaatccaggaagcgaagagccgtcactcggtttgatataaaatgatgtgatatctttgctttcttttgttttctgtataaccgtaaattctttatacccctgccatccggcttcattgtacatgtctttttcaatgccgataaaagcctccgcaataacaccgtaagctttttcccatgcctgcataatttcaggagttgcggcatcctgcagcacatccttaatcgccagaagcagatactttccgacaatcggataatgttccggttttacaccgatgcttgtgtgtttatggccgatctgtctgaccgccggaatgatttgttctaattgatcaatattcgccgcagccgcaatgactgcatttgccaatgctgcgcgctgagtctgtttcttttggttcgtttggttaaacatatttaacagttcgggatgatcttgaaacatcaggttataaaagcgtccggtgatgttttctccatgtgtttttaatacgggtactgtgcttttgatgatgtctactgttctctcatccagcatgttcatcctcaacccttctaaagatgtatttttaatatatctttatagtaagagatatttcgaataaaagatatatctataatgaatctttaaaaaagtcgtcacaatattgtgttggatttggaatttatggatttcacctccttttttatcacccggtgaaacagggacacatatatttgggaatatacgtttaaagatgaaagcgggggattgcatggtttccgatatcgattacacgtctccgaatacacagttcacttatgatgtaaatgagagccgtttttttacgaaagatgctcggaactttatcaatgtattggggattaaacagttaaacacgcttgaaaatatttcattattagatatctttctgagtaaaacaaatgtgattgaaccgcatacccatcaaaacgccgctgaattggtgtactgtatttcgggttccgcggtggtgtcgatgctgaatccgttcacccagaaaatacggaattatccgatctctccaggacaagtggcgaatgttccgcaggggtggtggcattatgaagtcgccacttcagacaaaacccaccttttggccatatttgacgccccttcgcctgaagtgatatacggctcggatattctccgtctgacgccgcctgagatcatggcgcatacgtactgtctgaatgagcacgagtgggaaaaagccgtttcaccgatccggcaatcaactgtgataggtcccgataaatactgcggacagtctgaaaacacgggtattcatgatatgaataaaccttatcagccaaatacgcattatccgaatgatccgtatcggcattatgttcagccgttctatagggggtattaagcggatccgcatcgacagaaagagcccctcattgcagaggggctcttgatcattacggtccggttccgcagcttactttgtactcgccttcggacgatttttttgaataacatacgtgcggcgtctgtccggtttcatctttccaattgaaccaatttacataataaaggttcccggcctctccgcctccttcttctttttgaagaatcgcaaagtagctttgatacggatatccttttttataaatgtcatgcctgatagctcctttttctgaagcagacgtgaagatgacaggagaaagagccgggagcgctgttaaaagaagtgccagtgcagctgacagagataatataagatagattttctttttcattttctctctttccttttttttgagttgttagaaatgaagcggaacacagaggctgctgcagaagatgaaaaaacaaaaaaacccttatttatagaataagggtttaaaggtatggagccaagggggctcgaacccctgacctctacgctgccagcgtagcgctctcccagctgagctatggccccgtgctgtaacgtcatgttttattatagacgactcttctatgaatttcaagcagaaaattcagtttgctcatattttcctgagacgtttttcgaacataaaaagaagaccctccggggggcctcttcgtttatcgcacgagcatgattaaaatgatgccgaggatgacacggtaaatggcgaacgggacaagcttaatccggttaatgagccgaagaaaaaacttgacgactaagagggcgacgacaaaggcgcagataaagccgacaagaaaaaacggaatcatgtcataagaaagactgctccagtatttcaccagcttcagaaggcttgcgcccgccataaccggaatcgccataataaatgtgaagtctgcggctgcccggtgattcaagcccacaataacacctccggcaatcgttgagcctgatcgggaaaatccgggccataaggcgagacactggaataatccgacacagaaagcctgtttgtaggtgattctgtccaccgtatcgatcgtttctttccttttattgatccagtccgctataagcataagcacggctccggcaattaatccgtaagcgaccgttctgacggagaataaatagcggtcaatgaaatcctcaaataaaaagccgagcaccgccgctggaacaagaccgacggcgatttgcgcgatggtcagcctgtatcccttctgctgatcgcgcgtgacgttttttttgaggccgagtaaatgtaatatccgatccttaaacacaatggccaccgccagaatcgaaccgagctgaatcaccactttgaaggaattggcggcttccggattcatcaggcttccggatttcagccagatgtcatccgctatgatcatatgtcccgtggaagaaaccggcgcgtactccgtcagcccttccacgattcccaaaacggctgctgtgaacatctcccatagtgtcatcccattcttcccttcattcatcatttacaaaagagaagctctcctttgaaggaaagcctgtcttataataaatatcatgtccgttccgattttatgacttcgatacagcatcatttttttcttcttcatataaatgcgagcgcattttgaaccaatcaaacagatgggtcgtgaccactttgatgaccgcataccccgggatggctaaaataatgccgacaaccccgaacagctttccggcggttaaaagaacaaagatgatggtaatcgggtgaatgtgaagatttttccccatgatctgcggcgaaattaatttcccttccacgagctggacaacggtccagacaatcgcaagcttcagcagcataaagggcgaagtgaccaacgcgataataatcgccggcgtgatagcaatggtcggccctaaatacggaacaacgctcgtacaagcggcaatgaccgcaagcagtgacgcataatcaagtccgataatcagatagccgataaataataaaaacccgatgcagaagctgacgatgacctgtcctctgatataggagcttaatctgtggttcatttcactcagcatcgtatacgtttgttctttcagacgggtgggcacaaactttaagatatagatcggcagttttttgccgtctttcagcaaatagaacagaataaacggcacggtcacaattgaaataatcacttcagtcagcgcgccgataaaattcccgactccggtaaatgtgctgtttgcaattgtcgccgcctgcgccgatactttattggcaagatcggaaatgttgatattcatcgtcttttgcgcctgatttacaaaatcgcttccgatcaggcttttcgtctgatcttcaacgatgtccacatatttcggcaggttgtcgatcaggctcatgatctgttcctttaaaaacggaataattgaaacgaccgtaatcgaaatcagccctataataatgaggtaaaggagcaggatggaatagactcttttcactcttattttttccaatatatctacgatcggattaagcagataataaacaattcctgtcaaaatgacggggagcgcaatcgttttgagcaggacgataatgggtgtgaaaataaatgatgtcttcataaagacaaggatattgagaccgatgagcagcaatacaagcaaaaacaagacaaatttattgtctaagaaaaactgtttaaatctgccgccccatgtttgcaatgtttccactattgttcctccatcatatgtattttacttaaattgtacactatcgttcctgtaatgaaaaataataaccggtctctatggggatttttcctatccgtttagctggcagccttttttccatttatgtttctttgaaaaaaagctataatgtaagccaatacatagaaggagcgatagcaatgattcgatttgcaacagtcggaacgaattggattacagaacgttttctggaggcggcttctgctattgatgattttcaattaacggcggtttattccagaactgaggaacgtgcggcggaattcgccggcaaacacggcgctgctcattatttcaccagcctgaaagaaatggcggaaagcaaagcctatgacgcggtgtatctcgccagcccgaatgcatttcacaaagagcaggcggtcctttttatggaacacggcaagcatgtactatgcgaaaaaccgtttgcgtctaacgcgagggaaacggatgaaatgattcacgcagccaaaacgaacggcgttctcttgatggaagccatgaaaacgacgttcctgccgaacttcagcatgcttcaaaaccacttacataaaatcggacccgtcaggagattcacggcaagctactgccaatattcatcacgatatgatgcatataaaaacggtacggtgcttaacgcgtttaagcctgaattatcgaacggttcgttaatggacatcggcgtgtactgcatttatccggccgtcgtcctgttcggcaaaccgaaaaacgtcattgcgaccggtcataaactagcatccggcgttgacggcgaaggcacggtcattctgtcatacgacggatttgaagcggtgctgatgcattcgaaaatctcaaattcgtttgccccggcggaaattcagggggaagacggcacgatcgttctggacagcattcacggaccggaacgggcggaaatccgctatcgtgacggacggacggaagacatttcagtccctgatctgaaaccgtcgatgtactacgaaacggctgaattcatcaatcttcttcgaaacggacagcgggagtcttccgaaaatacatttgaacgctctttcattacggcaagcattatggaagaagcgagaaaacaaatcggaatcgtctttcccgccgatcaaaactaaaaacatccgcccggattcgggcggatgttttttatttggacgctaacaggtcagcaaacgcttttgcatactgcggaaggtcgggcgggcggcggcttgatacaatgtggccgtcagttacgacagcttcatccagccactgtgcccctgcatttgtcatgtcgtctttgatgccgggcgtgctcgttactttttttcctgcgagaattccggcagatataagcacccagcccgcatggcagatctggccgatcggctttttctgctcgttcatcgtacggatgatgtccaaaacttcgggatatcttcgcagtttgtcaggagcccagccgccaggcacgagcacggcatcatactcctgaataatcaggctcttaaaatcgtaatccgccgtcgcgggcacgccgtattttcctttgtatgaacggcccgcttcttctcctattaaatgaacgatcgcgccttcctctctcagccgatagacgggataccaaagctctaagtcttcaaaatcatcactgacaagcgctataacttttttgccttctaatctcatcactgccactcccttcttttatattagtgtatcgcttttttcagatgaggaaaagaaacagctcgttacagctgttcttcgtcttcagactgaatcgtaaatttccgtgtgacctgctgcagttcttcagccatatgcgcaagcgtttcggcggatgaactgatttcttccatggaggccagctgctcttcagctgaggcggcgatgtcttgaatgccggcggacccttctttggcgactgaggtaatgtcctccactgcgtttgtcacattttgcgacccggctgcaagctgctcaagcgttccgttcatatgctgcaaggcgcctgaaatctgagtcgtcatttctgagatttttttgaagctttcggccgtttgatccgtaatatcgaggccttccttcacatcttgattcaccgcttggaatacggaaagcgatgtggcgatttctttgacgatttcctgaatcagcgtttcgatttcctttgcggagccggctgattgtacggcaagcttcctcacttcttccgcaacgacggagaagccccgcccgtattcgcctgctcttgccgcttcaatggccgcgtttaaggcaagcagatttgtttgatcggcaatgccgttaataacgttcagaatgctcttaatgtcgtgcgacttcgtttccagcccttttacgacggcttccgcctgctgtacggaacgatcaattgttttcatctggccgaccgttttcgccactaattcttctccgcttccggccgtttcagaggtttggatggcggattcagtgatttccgccgatacattcgccgtctcggcaatgccggcattcatttgggaaaggtgatcggcactttcttccaatttctcgctttgtgattcgtttccgtttgagaattgttcaatcgccagagtaatatgctctgtcgccttgcttgtctgtccggcggatgccgtcagctcttcggatgaagaagcgacatgttcgacggatgattggatgacgccgatgacagaccggagtgatgccgacatctcattgaagctttggctgagctgcccgaattcattttttgacttgatgtcaatgacttccgttaaatcgccgtcactgattttagctgatgtcgagacaagttttttgagcggttttgcaatcgagcgaatgataaagaagattaaaataccgccgacgataagagaaaccgccaggatgatcagcgccattttcatgacaggcgaggctgcgtcatggatctcactgacaaaaaatgtgccggcgattttccagcccgtcagtttgtttgtcgtgaaggccattttcttctgctgtccttcaaacatgtattcaaacgatccgcttgatttggaaaatacttctttcgtccactctccggagccttccgtacccgcttttatagtcggatgggcgatgtattttttatcccccgttgtaatgaaggcaaatcctttatgaccgatctggacgcgttcggaagcgttcagcaggtcgcccagattaatatcaagcgccacaacgcctgatccgtcttttgtctgctgggcaatcgtaacgaccgtctgtccggttgcagcgtctttataaggctcggtaaacaccggctgtccgcttttttcaaccgcctttgtataccactcgcgcgtgagcggattataatcggacggcatgtcagcggacggatatttcacgaacgctttgtcgcgagacgcggcgtaaattgacgcgacatcgccatttacggtgacatactgcttcatattgtcgagcagtaccgatttatttttcgtgttcagtttttcctttgtgattgattcgctgtagtagtcaatcgctttcagcttaccctcaagcatgttttccagcacgctgttcagttcactgacatttccctgggcgctgtgggtcagttcgctttctaatgtactccccgccgtttggtagctgaagtaggcgagtatgccgaccggaagcaccaatacggctaaaaatgccgcgatcagcggcttgctgatggatggctgtttgatccaatgtatcagttgtttcattttttcagtctccttctttgaaaagctaaatctaatatcgtcagataggacaaaagatttattaaaaaaactaaaaaaacacccaaacagcacatttgggtgttctatgatctattaatctattttaaatcgtttcgtcatatcacgtaattcttccgccatttgggataacgtttccgaagacgaactgatttcttccattgaagccagctgttcttcggcagaggccgcgatatcctgaatgctggcggagctttcttttgcgatggacgcgatttgctcagaagctcctgaaatctgctgtgatcctgctgtcagctgttctaccgtcgcattcatattctgaatttctccggcgatctggttcgtcatttcagaaatccgtttgaagctcgtttcggtctgattcgtaatatccagtccgctctccacctctttgttgacggattggaacatgccgagagatgtattgatttcgttgacgatttctataattaagctttcgatttctttcgctgaatcggcagactggaccgcaagttttctgacctcttcggcgacgactgagaagccccggccgtattcacccgcacgcgcggcttcaattgccgcgttcagcgcaagaaggtttgtctgatcagcgattccgttaatgacaccgagaatgtttgtaatgtcttttgattttgtttcaagtccgcgcaccacttgttcagcttctttcactgaccggtcaatgacgttcatttggccgaccgtctggtggacgagctttccgcctgaattggcgacttccgctgatgtggcggaggattcggtaatgacggcagatgctttcgccatatctttaagcccgctgttcatttgataaatatgttccgccgcgctttcgatattttcactttggctttcatttccgttagaaaattgttcgatcgccagtgtgatatgttccgttgccttgcttgtctgctccgctgaagccgtcagctcttctgaggaagatgcgacgttattcacggaatcctgaatggcatggatgagagacctgagtgaagcggccatattgttaaagcttttgcccagctcgcctaattcatcttttgactgaatttcgatcgtttctgttaagtcgccttcactgatctgtttcgatgatgtcacaagctgcttgagcggttttgtgattgaacggataatcagcaccatgacgatggttccgatgacaatcgctaatacgagaacgagcagggacagatgaaggatcggcagggccgcttcatgaatttcgtccagatacatcgttccggtaatcttccagcctgtcagcccgttcgtatcataagccattttcttttcctggccgtcgtatttgtattgaaaatcaccttttttgctggtgaacagctgttcagcccactccccgtttaatactgtgcctgacgcacggttcgggtgggcgaccacttttttgtctttcgtcaggataaaagcgtagcctgattttccgatgttcactttctttgtcgttttcagaagctcatcgattttcatattgatggcgacgacccctgagccgtctttcgtctgctgaacgaccgtcacgaccatcgtattggtggaagccgtgcggtaaggatctgttacaacaactttccccttattttccacggcctttttataccagtctctttcaagcggattatatcctttaggcatctgcagatccggataccgtgtgaaatgtccttccgtgtcactcgtatagatggattccacgtctttattaatcttcatgtactctgtgaatttatcggtaatttgcgattggtttttcggcttgtaccgatcctttgtgagccagtcgctgaaatatgccgttccgtcttccttttggctgatgcttgtgttgatcatatcgttaatctgctgcacattatctaatgcgcttcccatcatctgcctgtcaagcgtacttaccgccgattgataggcgataaaagccagcgttgaaataggaagaatgagaatggccaaaaaagaaatgagcagttttcttgtaagcgatctctgcttgatgatttgcacaatttttttcatctgctatatctcctcttgcgtgtttacccttcatatcggcaattatgggtaaatatacacatccaaaaagaagaaatataacgaaacatactttttacctattgcaaaattagtcttttagacttaattaagagtttatcttaaaacgctttgtcagttcgcgtaattcttccgccattttttccagcgtgacggctgaggaactgatctcctccatggacgcaagctgctcttcagctgaagccgcgatgtcctgaatgccggccgcgctttgtctggagactgccgcgatatcctctgaagcgtttgatacttcctgagatccggcagaaagctgttccacggttgcattcatattttgcagttcaccggcaatctgacttgttttagcggaaatgtcccggaagcttttttccgtttcgtccgttaactgaagtccgcttttcacctcgtgattgacggattccagcattccgagcgaagtatgaatttctttgacgatttcatgaattaaggattcgatttctttcgctgaatcggcggattggacggcaagctttctcacttcttcggcaacaactgaaaaaccgcgtccgtattctcccgctcttgccgcttcaatggctgcatttaaagcaaggagattcgtttgatcggcaatgccgttaatgacgcgcaaaatgctggtgatgtcctgcgatttgagttcaagcccttgtacgacttgctccgctttacttacggattggtcaatggcgcccatctggccggctgttttcttgacaagccgctcaccggcgccggatatctccgccgattcaattgaagtttccgtcacaacggctgccgcttccgccagatcgctgagcccgtctttcatctcattcacttgtgctgtcgctttatcaatactctcactttggtcttccgttccattagaaaactgttcaatcgcaagggtgatatgttccgttgctttgctcgtctgctcagccgaagccgtcagctcctctgaggaagaagcgacatgttcaacagagtcctgaattccctgaataagcgaacggagtgaatctgtcatatgattaaaacttttaccgagcacgccgagctcatcttgagagctgacatcaatggtttccgtcagatctccgctgctgattttttccgctgaagctacgagacgttttaacggtttggtaattgagcggatgacaaaataaatgaaaatcatccctgcggcaatggctatcgccaatatgataacggccagagtcagaaccggtcttgccgcatccttgatttcatccacggacatggttccgctgatcttccagcccgtcgcttcattggtcacgtacgccatttttttcgctttcccgttcagcgtatattcatagtcgcctttttgcccgctgtataatgtatcaacccattttcccgataccgccgcgccggctttttcatcactgtaggcaacggcttttttatttttgctgaggataaaggcgtatccttcttttccgatgttcacttcttttgtcatcgtgatgagatcgtcgatttttatatcaatggcgacgacgcctgatccgtcttgcgccgcgcgggccatggtgacgaccatctttttgtttgagatggactcataagggtccgtgatgatggtttggcctttattctccatggcttcctgataccagcttctttcaagcggattgaaatcggccggcatatcggcatgcggataacgggtaaacgttccttccttgctgcttgaaaatatggcggacgctttatcattgctttcaataaactgtttgaacctttcttgcatttccgtttggtttttttctttaaatttagcgcttgtcgcccattcgctgaaatatgcagagctttttgtaaacattccgatccggtcatcaatcatattgtttaagatttgcacatttccttcggcgctttccatcatttgcttttcaacggatgaagccgccgaacggtaggcgccggcggccaatactgctaccggaataattaagatcagtaaaaatgaaatgataagttttttggctattgattttctggcgattttttttgctgtttttttcaattttgtaaacctctttcaatcatttactgtttatatcggccgactccctttttattacattgaaaattaagtcataaatgaaaaatagttctatgtactccctttgtatgcaagactttttatttaattatccggctgtcactataaaaaaggacgccttccacctggaaagcgtccttttttactagttgattttaaattgtttcgttaattcccgcagttcttcggccatttgcgccaaagtatcggcggatgtgctgatttcttccattgatgcaagctgttcttctgcggatgcggcaatatcctgaatgcttgctgcgctttcccgtgatacgtccgcaatatcggtcactgcggctgaaacgtgctgagagctgtctgacagctgttcaaccgtgccgttcattgattgcagtttttcggcgatgtcgttcgtcatgccgaagatattctggaagctttctttcgtgcgatccgttacggcaagtcctgattgcacttcttcattaacggatgtaaacatgtgaagcgaagtattaatttcagccgtgatttcctgaatgagtttttcaatctctttggcagaaccggcggattggacggcaagctttctcacttcttcggctactactgagaagccccgcccgtattcaccggctcttgccgcttcaatggctgcatttaatgcaagcaggtttgtctgatcggcaataccgttgatgactcttaaaatatgagtaatgtcttttgatttggcctcaaggccttttacaaccgcttccgcctgctggaccgattgattgatgagattcatctgcccgacggtttgctgcacatattcttccccggtgccggcagcttccttcgattgtttagatgcctccgtaatggatgatgatgtgcgggaaacggcggcgagtccgtcatttatatgattcagcttggctgagcttgaatcgactttttcgctttgctcttcgttcccgtttgaaaactgctcaatcgccattgtaatatgttccgtcgctttgcttgtctgagaagctgaagcggtcagctcttccgatgacgcggccacgttatcgacagagttttggatcgcgctgatcagtccgcgcaaagattctcccatttcattaaagctcgcgccgagttcgcccaattcatctttcgagcggatgtcaatggtttcagtcaagtctccgccgctgatttgtttagaagagcggacaagccgtttcagcggtgacgtaatggatctgacaatcaacagaattaaaattcccccgatgataatagatgctgcaaggacaatcatccccatcgtcagcaccggttgtgaggcatctttaatttcgttgagctccatgctcccctctattttccacccggtcagtttatttgtcgtaaacgccatttttttattttgatcatcgagcttgtatgaaataatgccgctgtctttgctgtatacctcattcagccacggcgttgaaactttatcgcccggtttgtggtctttatgcgcgacataggttttatttttggacgtgataaacacgaatcctttttgcccgattttgattccctgcatctgcttcagcagctggtcaatcgtaatatccatggccactacgcctgttccgtcctgcatctgctttgccacggtaatgaccatgctgccgtcgcttgccgcggtgtaagggtcggtgacaacgagcgtgccgccggccttcacagcgtctttataccaagtgcgtgttctcggatcgtaatcggccggagtattttccttcggcgcctgtgcgtagctgccgtcttccgttcctccgtaaatgcgggctacgtccttatgaatagacgtgtattgcccgaacttttcttcaagagcagacatgtttttctttgagaaggatgatccttttaacgtttcactgaaaaattcaatcgcctttgcttttgcgccgatatcatttgtaatcgttgtgttaaaagattcgatgttatttttcgcgttgcctgaaatctgatcatccagcgaattgctcgccgtatggtatgaactgaattctaacacgagaatcggtatgattaagatcacgataaatgaaatgattaatttccgtgaaatcgatgcctttgtgcaccaattaatgaattttttcatattaagctgctccctcaagtgtgataccttatatatcggctcagtcttcacattttgttaacatttcctccttttttatcacttgattttcattgcccaagcttcctgcatatcttataaaaaaagatagggggcgcgcagatgattatcatatccggccaagtgcttcggcctcaggacatcgcgaactggcagacggaagaaagccttgttccgtatataaatgaactgctcaattctcccgtacaattcgattacgggtcgattgctgaactgatgttcgaggtgcggctgcgccgccatattgtggaagccgcaagagaactgcacggatcaggtgtgaaatttgcaactttcgccaaaacatacggaaatacggcttattggagactgacgccggaaggagccctggagctgaagtacaggattcccgcttcaaaagcgattcgggatattattgaaaacggggcgttttacgcatttgaatgcgctaccgccattgttgtgatttattatctggccgtcttaaagacaatcggtgaagaacggtttaaccggcgtttccgggatatcactttgtatgactggcactatgagcatctgccgatctacacggaaaccggcagccactttttacggggagactgtttatattttaaaaatcctgattttaaccctgcaaaggctcagtggcggggagaaaatgtcattgtgatggggaatgatcaatatttcgcccacggtctcgggattctgaccgctgaacaaatcatccagagattgaattctttaagaaaaaaaaatgccgtgcagccggcttatctgcttaaccaggcaacaaggcttgatgcacccgcgctttatcagatcatgcattaaaacaatcccatcgtctgtcattgtgacgatgggatgtgaaatgcttttcttttccggtaaaaagccgtcgtgccgagcgcttggtttgcagcccattcaaacttctctaaatcatggcgggtgacggctctgtcccgtctgctccatttaatggcgcggacaaagtaataccctttaatcggcgccatggtgactttggaatgcggaaaatcttcaaagacaaactcaatagtccctctttttttataggacatttgaagaatcttcatcatccatcacctcacgatttctggattatgattcgcacaatctgtccaaaacggttttcacgtctgtcggcccctcaagtttcgcggcggactggccggcccataaagacatatgctccgcgtctcctgattgagccgcgtgcccgcgcatcggctttgtcagcgtattatgcagcggataaggcagcgtttttccctcgtcagcttcatatgttttcatgaactgattcacgattccccgcgcctgttttcctgaaaacagggtggtcagccgcgtatcggctccttttgattcggcaatggctttttgatatgccggtgaggcgctgctttcttcacaaaggagaaacggtgttcctacttgaacgccgtccgcacccaaacatcgggccgcctgcaccccgcggcggtcaaaaatgccgcctgccgcaatcaccgggatattcagcgtgtctttagcctgcggaatcagcgccataaggccgagagccggttctcctttaaccggcagaaacgacccgcgatgcccgccggcttctattccctgaaggataacggcgtccattccccgttcttcaaaagccttcgcttcctccggcgttgtcgccgtgccgaaaaggaaacaaccgcttttcttcagcttttccgccgttttttccggcggcaggccgaaggtgaatgaacacgctttgactccgtaacggatcagaagctccgctttttcctcgaaatcattccattcttctttcagatcagagaacggcttggcgtcttttgccctcggaatgcgggctttccatttttcaacaagttccgcctcaggcatctgtctttcttccgggacgaaaagatttacttgaaaggagcggtccgtcagctctttcatctcgataagctgtttttcaagcgcttgcgggctgacgtatcctgaagcgaggcttccgagcgccccttcatttgataccgccgaagccagacgcggcgtgaccagcccgccggccatcggggcctgaatgacgggctttgttaatgataacggactcatccactcactcatttgttttcctccgtttcagccagtattttgatataacatgttctgtttcgcggaccgtcaaattcgcaaaaataaacgccctgccatgttccgagtatcaggcgcccgtcttctatgatgacatgctgagaggcgccggttgtactcgctttcatatgtgccgccgtatttccctccatatgccggtccagttcgtgctcccacggatacatttcatcaaaccttctgagcatatccctcttcacatccgggtcggcattttcattgatggtaatgccggcggtggtatggggacagtatatgagcgccaaaccgttttttacgcctgtttcgcggagaaacgattcggcttcatgtgtgatgtcgatcatttcatcccttttttttgtttgaatctgcaattttttcagcatatgaatgcctcctttctttttctcttcctttcccatattcgtttctgtatttgtcttttcctgtcggatcgcgatgataaacgcagatcacaaaaaacttcagcctcgggactgaagtttttcaccatatatatacgcgtgcctcataaggctttaagaggaaggatgtcacatggcggtgcgattctgtttccgcgtttgcaagcacgagagaatcggagtcaagcggatatccgggatgcctgtataaagcgggggttcgggacagatttgtgatgatcagggcggtttttgttccgttttttcttagataggcataaatctgccggtcattcggaagcagcaattcatatgtgccgctgatcaatacgtcgtgttcttttctgagggcgagcagccgtttgtagaaatggtatacggatgtttcatcctgcaattgtgatgcagcgttcagccatgtgtgattagaattcactccgagccacggagaagcatcagaaaacccgccgttcgcctcaccgctccattgcatcggtgtccgtgaattatcccggcccttcttccagatgatcttcatcacttgttcatgcggaacgccgcgggacgtctctttttcatacagatatttaattgcggcgtcatcataatcttcaatggatgggaacgaaacattggtcatgccgagctcctgtccctggtaaataaacggcgtgcctttcatcagcatatacatcacggcgagtgccttggcgctttctgtcaaaaaccgttcgtcaccccataccgaaacggatcggggctggtcgtgattttccataaataacgcattccagccctttccttcaaggctgtactgccagccggacaagacgcgcttaagcgccggaatggaaatgctttgatcatcttccgtatcccagaggccgagatgttcaaattgaaaaatcatttgaaagacgccgttttcttcaccggcccaatcagccgcctcccaagccgccactccgttcgcctcgccgaccgtcatgatcggatagcccgaaaatgtttcccgcttcagctcttttaagagatccattatgccttccccattcatatgatacgggaaagacgggacgtacgggagaccgtccgggttcggcatgtcagggagtccttcttttttcttaatgtgagaaatggcatccacccggaagccgtctatgcctttatcaagccaccagcgaaccatctcataaacggactgcctcatcgcttcgttttcccaatttaaatcaggctgttttttgtcaaacaggtgcaggtaatactggccggtctcttgatcatattcccacgccgatccgccgaaaatgctttcccaattattcggctctttgccgttttttccgtctctccagatgtaccagtcccgtttttcggaatctttcgctgagcgtgattcgataaaccaagggtgctcatcgcttgtatggttgatgacgaggtctataatcagcttcatgccgagcgcatggacatccgcaaggagccggtcaaaatcctccatcgtcccgaattcgccggcaatttgtttataattccgaatatcgtagccgttgtccgcgcccggcgagtcaaaaacgggacaaagccagatcacatccgcccccaactcttttatgtaatgaagctttgctctgatgccgttaatatcgccgattccgtccccgttcgaatccataaagcttcggggataaatttgatagacggccgccgttttccaccaatccgttttcataccgacactcctttctttacagcatatgaaggagcgggacgaagaagcattttttccataaaaaaagcctcattgcaaaagcaggaggctcagaaatcagtttttttaatctcaacgaagcggatatgatggtcttccgcttccagcaccttaaattcacacccttcggcatgaaacacatcaccatttttcagctccattttttgtgttaagagccagccggcaatcgtgtcaatgtcttcattttcgatggcgatatcaaggagatcattcacctcttctatgagcgccttgccgtccatcacataatggtgttcgccttttttgacgatgtggggcatttcatcctggtcatattcatcacggatttccccgacgatttcctccaatatgtcttcgacggtcacaagtcccgccgtgccgccgtattcgtcaacgagaatcgccatatgaatccgctccttctgcatgcggatcaaaagctcctgaacggggatgctttcaatgactctgatgaccgggcgcatcatttcttttaattcaatggagcggccgagaaaatacgctttaaataaatccttattgttaataatgccgagaatgtgatctttgtcttccttaataaccggatatcgtgtataccgttcgttgatgatcaaatgtatggcttcatcaactgactgttcaagcgagatgacggcgatttcggtgcgcggcaccatgatttctctggcgacccgattatcgaattcaaatattttattgacgtaacggaattcagattgattgatttgaccttttttatagctttcggataaaatcagccgcaattcttcttcactgaccacgacctcatgttctttcaccgaatgaaaaccgaacagcttgaccaaaaatccggctgagccgtttaacagcttaataaacggatacatcactttataaaacagaatgagcggtttcgccgtccacagactgacagcttcggctttttgaatggatatcgttttcggcgcaagctctccgatgacgacgtgcagatacgtgacggcgataaacgccgcaataaacgtgacgacgtgcgtaatagatgacggcattccgatcaggctgaaaacaggatgaagaagccgctgaatcgtcggttcaccgagccagccgagtccgagcgccgtaatcgtaatgccgagctggcacgctgataaatattcatcgagatttgaaatcaccctgtgcgccgcgagcgcccggctgtctccggtttcaaccagctccgcaatttttgaaccgcggattttgacaatcgcaaattccgcagcgacaaagatggccgttaatccgattaacagcataatgagaatcagttttaatataagcaaaaaaacccctaccgcaaacggtaaggggccacctccttcgtgttaattctcatcacgaccatttaagaaaatcatcacaaaacgaagcagctcgaataatgaaacgagcgccgcagccacatacgtcagcgcggcggcgttcagcactttattcacgccgtgttcttcactgttgcgaatgaatccttccgacacgataatccgcttcgccctcgcgctggcattaaactcgacaggcagtgtgacaagctggaaaaaaacagcggccgaaaacaaaataatgccgagtccgattaagttcaagctgcccaggagcatcccgcccaagaaaagcagaggggcaaccccggaggcaaaattgacgaccggaaaaattttgtgcctcagcacaagcgcgccgtatgattcctgatgctgcaaagcatgtccgacttcatgggaagcgacggaaatggcggaaatggagcggccgtaatataccggctcagataaacgcaccacccgctccgtcgggtcgtaatggtctgttaaagtgcctcttaccggttctaccggcacatcatataaaccgttaatatcaagaatccgtcttgccgtttccgcccccgtccgctgactggaggcttccacgtctgagtatttctgaaaattgcttttcactttaaattgtgcccaaaacgacaaacccaatgcagcaattgttaaaaagataaacagcatattatcctcttcctttttctcttatatcgtacgatctgcttatatattattttaatgattgcccgctttcctgtacagaaatccgcttcttttttctgacaggaatcaatcctccgagcatgatgaggatacacccggccattccgatgtaaaacggaaacgtgcctgcggtctcttttgcaaaaacaagccatgaaaatccgccggacatgtgattgtatccattcaaatcgaaaataagcaatacggccgccgaagcgagcagctgcgctccggccagcgccgccagcagtttttgaatgactgtcatttgactcaccctttttcggtccgctttctttatcatatgaaaaaataagggtgaatatgttttcggcgatttttgaaagacatcaaacgaactgggacatactgtataaaaaaagatacaggtgtgatcgacatgaaagtgacaaatggcgagaaagaacagctgagcaatgcgatagacagaatgaacgaagggcttgacgccttcatccagctctataatgaatcggaaaacgacgaacctctcattcagtttgaagatgagacggccgatttaatcagacatgcgcgtgactcatacggccaggaacagctggacgaaaaactaaacaccattattaagcagattttatccatctctctgtcgaaagaagagccggacgaatgaaatcaaaccgtatttttatttcctggctgagatggccgttatatgttcggatcgggctgatcattatcgccttgattttattgttcggccaactcatttacatgctcgaaccgaagcaattcacgtctgtgtttgaaggggtttggtgggcggtcattacggtggccacagtcggctacggcgattacgttccgcagacgccgctcgggcagattgccggcatggtgcttgtattaagcggagcgagttttgtgaccgcctatttcgccacgctttcttcagccgtgttcagcaaacagcaccgctatgtcgaagggaaggtcgcctttaaaggcaaggggcacgtcattcttatcggatggaacgaaaaatcgcatatgctgctgaaagagctgcagcacatcgcaccgtcaaaaactgtcgtcctgattgatgattcattaagggaaggtccgcttattgaaaacgtccatttcatccgcggacatgccgctgatgacagcacgctcaataaggcgaatattacggaagctgataccgtcattctgacagcggaccagcagaaaaatgaatccgaagctgatatgctgtcggtattaacgcttctcgccatcaaagggctgcatccgtctgtttattgtatcgtagaaattttaacggaacggtatgtcaaaaacgccgagcgcgcaggagccaataagattctgtgcacatcacacctgtcgagccgggtgatgtttgagcattaccgggtcaagctgcagcttgccaaaccgcaaacgctgtcagatctgacgctggagaaaaaggtgcgcatcattcctgtccccgaggaactaaagggctcatcttatcatgactgcgcgctctattatctcagacggaataccacgatcatcggcatacaaaaagaagaggggccgatgctgacccctcccctgtcataccaggtgctcgatactgatctgtttttggctctttaatgcagcaggacgtcttccagctctttcacaagcgagatgccgatatctgtatatgagcggtcaattgccgcatcccgccgtttcggctcggagaattggttgaataatgactcaaaaacaccgccgcctgctgcatcatccgtttcctgctgataaacgtgcctcagcaaaaagggtgtgccgattgtaacggcggccccccgttcatccaggtgtcccttatttgcttcaacagggatacggagaaataaatagccgtcctgatcggaaattttgtaatcaaagaacccgcggtcatactcccagccgcctccgatggtataaccgatcggtttcatcacctgttccagttcgcggagtaaaaacgattgcccttcaagtgaagatggtatgctgatcatgtgcatatgctcctttttgtctttagcgtccccgctctgcggcatcttcatacggcgtccgggaagaaccgggagcggcagacagacgctgaaaagaggtgacggcgcattcaatcagaacatacgtcacaattgcggagagagcggcttccgttgaaatatagaaaacggcggcatagagacagcacttcgtgatcagcgtatgcatccggccaatcttcagtttcagccggaccatgtccataaacaagccgagagggaaagcgaaaaacaggatggtttgcaagagggattcgggagacagttttagtgccgaatagacgatagcggcggaacagacggaaatgaagacatgcttacataaaagccgcatcaattcatcatcacacctttcacggtttaaaaaaggctgacccgtcatgctgagggccagcccttctttttatttttcaaggcgtttttcaagctctgcttttttctcttcaaagcccggtttgccgagaagcgcgaacatattcaccttataggcttcaacacccggctgatcaaacgggttgactccgagcagataaccgctcatcgccaccgctttttcaaagaaataaacgagatatccaaatgtatatgcgttaagctccggaatattgacaattaagttaggcacttttccgtctgtatgggcaagcatcgtgccttcgaacgcttttttgttgacgaaatcgaccgttttgccggctaagtaatttaagccgtcgagatcattttccgcttcttcaattgtcagctcatgcttcggtttttcaacgtttaatacggtttcaaacagatcgcgtctgccttcctgcacgtattgaccgagagagtgaaggtctgttgagaagttagcggaagaaggatagatgcctttttcatcttttccttcactttcgccgaagagctgcttccaccattcagcaaagtattgcagcgcaggctcatagttgatgagcatttcaatggttctgcctttattatacagaacgttgcggacgacggcgtattggtaagccgcgttctcttctaattccgagctggaaaagtctttgcttgcatcaagagcgcctttcatcatttcatcgatatcagccccgcttaccgcaatcggcagaaggcctaccgcagtcagaacggagaaacgtccgccgacatcatcaggaataacgaatgattcgaagccttcttcattagaaagcgtttttaaagcgccgcgttctttatctgttgtcgcgtaaatccgcgctttcgcttcttcttttccgtatttttcttcaagaagtttgcggaaaatccggaaagcgattgcaggttccgtcgtcgtgcctgacttagaaatgacattgatagagaaatcagcgtcttccaaaagatccataacatctttcatataagttgagctgatattattgccgataaagataacttgagggtttttgcgcttatctttcggcagaacattatagaaagaatgattgagcgcttcaatcgccgcgcgggcgcctaagtatgaaccgccgatacccacgacgagaagcacgtcagaatctgatttgattttttcagcgctttttttaatgcgcgcgaattcttctttatcatagttttcagggaggtccacccagcctaaaaagtcgcttccggcgcctgttttttcatggatattatggtgtgccgtttttacgaaatcacgtgcgtatgtaagttcatgttcattgaaaaaaggtaacgctcttgagtaatcaaagcgtacatgcgtcatttgcttgtccctccatcacggtgaattgttttctctttcactttatatgaactcacccgctaaatcaagtcatgaagaaggcatgatgaatacgggatttgcgctgaagatgcgctcattttttatacaatatcccggattcgaaatagttatatttgtaataatcgtgaaagaggtaacgaatcgaatgttggtgatccaggaacgtatcacctttactttggagcaggttgacatccatcgccaatacccatgggacggttctttttatatagtactcctcttgagaggctgctaagcaggcatattaaggtataaatgtccatttttaaaaatagtgtctatatttgggttatcatgttaagatgaaaataattttaaaccgggaggtgattctttgactaaaaccattggtcttatttgtggaagtttacgaaaaaactcgtataatcgagtgattgctcaatcattgattgacttcgataatgcggctcaatttcgctgggttgaaatagacagtcttcctttttttaacgaagatttagaaatggccggagcaccagactccgtaacatcctttagagctgatatacgagacgttgacggcgtcatcattgtaagtccagagtacaattccggaatcccgggggtattaaaaaatgcattggactgggcatcgtgaccgcggacctcttccgttttaaacagaaaaccggttggcttaatcggcgcaacccccggagggttcggcacctcttttggtcaaatgcaaacgagagaagtactcgaagctatgcaagtcaatgttctgccctttcaaaaaatgctgatttcgcaagtccatgagaaaattgattccgctcaacacatacttacggatgaacaaacaaaacgttatcttcaacgctatttacaacagttcatccattggattgatcatgctccggttcccattccggattaattgaaagatcatcaccttcacgaaaagtcacttcagaaataactttctacctatacagtatatgaatagatttaccgttttccattgacaaactgacttgccttaattcaaggaggatgataaaatgtctgatctttattcccgtctttcaaaagatgatgctgccgtgcttttagttgaccatcaaaccggccttatttccggtctcgtgcgtgactatggcgttgatgaatttaaaaacaatgtattggctctcggtgatacggctaaattctttgatttaccggttattttaacaaccagctttgaaaatggacccaacggaccgctcatgcaagaactcgttgatctctttcctgatgcgccaaaaatagcccgtcccggacaaattaatgcatgggacaatgaagactttgttaaagccattgaagcgaccggcaaaaaacagctgattatcgcgggggtggtaacagacgtctgcgttgcttttcctgcgctttctgccattaaagcaggctacgaagtgtttgttgtgacagatgcttcggggacgtttaataagcaagtagcagatgcatcattaacccgtatggctcatggcggcgtgcagcttatgaactggttcagcacagcatgcgagcttcagcgtgattggcgcaacgatgttgaaggttttggcgcattaatctccagtcatcttcccggttatcaaaacttaatgggaagctatatgggggcgcagcgggaccttagtacacaaaatgcataaaaaggagcgctgattgaatcagcgccccttttttaaattcgcggctcttcatcttcgtgatttagatttcgtgtaaatagatgacagacaatcgcaaagttaattggtcctttacggatgaaacgatttccatagttgtctcatggaaaagggtgtttcacttgctcctaatgaactaatagaaaatccggaaagagggactcccaaaacggttacatctgcagcttgaaaatcactccggccgggaatgtatcttacagtgacgcctttaagatggcaagtacatcatctttgttcagtttttggaaattgccgaatccgccgtattccatttcttttgcggcgatgtctgcgatcagctcaagcttgtcttcgccgatgtcataatccgcaaggcgggacggtgcgccgaggcttgtccagaacgcggacaatttatcgatcccttcaagcgcaatttctttatccgttttgccttcagtatcaatgtcaaacatattaagcatgaggtttttaaaacggtccacatttgtatcaagcgtgtatctcatccagttcgggaacagaatcgcaagtcctcccgcgtgagggatgtcataaaccgctgatacggcgtgctccatcgtatgggaagcccaatcgccgaaatagcccatttgcagcgtgccgtttaatgcgatcgtacccgcgtataaaatcgtttcgcggtgcttatagttctcaaggtcttccaaaagtttcggcgctgtttcaattaccgtctgaaggaccgcaaaacacattctgtcctgaagcggcgtgttttcaacattgtggaagtattgttcaaatacgtggctcatcatatccaccatgccgtatacggtttggttttccggaacgctgaaagtattctcgggatctaaaatggagaaacgcggatgagtgacattgctgccccatacgaatttttcgtttgtttcccaatttgtgataacggaatcagggttcatttcagagcctgtcgccgcaagcgtcagcaccgtgccgaacgggagcgcgtcctgcgccgttacttttttgctgtaaatgtcccatgcgtcgccgtcatatttcgcaccggccgcaatcgcttttgtacagtcgatgacacttccgccgccgactgcgagaaggaaatcaatctcatgctgtctgcacagctcaattcctttatttaccgtttccagacgcgggttcggttcaacgcccgcaagttcatgaacggctgcgccttcttcttttaaaatgcctgttacttggtcatacaggccgtttcgcttaatgctgccgcctccgtaaacaagcagcacgtttttcccgtattgcttcagctcttttttcaattggtcgatttgaccttttccgaaaatcagtttcgtcggattgcagtacgtaaagttctccatttatcatgacctccaaaaaaatcgtaagggaattactataacacagaaaaaaaggagctgccaatccggccgcccccctttatgttattacaatgatgctttcagtatcgcaagcacatcttctttctgcagtgacttgaactgtccgaatgctccgtttgccatcgctttatctgcaatcgtatccagcttctcatcagaaatatcgtaatcagcgagtctgttcggagcgccgaggctcgtccagaattcagacagcctgctgattccttcaagtgcgatctcttcatctgatttgcctgtctcgtcaatatcgaaaacacggacggcaagctgtttaaagcgggccggattttctttgagcacatgtctcatccagttcgggaacagaatcgctaaacctccggcgtgcggtatatcgtataccgctgataccgcatgctcgatgttgtgtgtggcccaatcccctcttgcgcccattgacagcattccgtttaatgcgatcgtgcctgtatataaaatcgtctcacgaagctcatagttctccagatcgttgatcagcttcggcgctgtttcaatcaccgtgcgcagaagcgattcacacatccggtcctgatacggcgtgtttgacgtgtggtggaaatattgttcaaacacatggctcatcatatcgaccatgccgtaaatggtgtggtctttcggaacggtaaatgtgtttaccggatcgagaatagagaatttagggtaaacgagcgggctcccccatccgtatttctcttgtgtctcccagtttgtgatgactgatccggagttcatctctgaaccggtcgccgcaagtgtcagcactgttccgaacggcagcgcttctttcggctggtgttttttcgtgacgatatcccacgcgtcgccgtcatatttagcgcccgccgcgatggctttcgtgcagtcaatgacacttccgccgccgacggccaataagaaatcgatgctgttttctttacagatcgcaacacctttgttcaccgttgagacacgcggattcggctctacgccttccaattcatgtacggtaactcctgcttttttcagcaggtcggttacttgatcataaagaccgctgcgcttaatgctgccgcctccgtatacgagcagtacgttctttccgtacggcttgatttcttcaggaagtttttcgacctctccctttccgaaaatcaatttggtcggattccaatatgtaaagttttgcatgacatctcctcctttggatttatattatgcagaaagttgacgttcaatgtaaagcaatccgcttttttgacggcacatcacacggtttacagacagcggtttcccgggaaagggacttgtacagcttgagacagtgtgtgatttacacggcggagaatgtagtatgcatagattctttgctttgtcacaatctataactgtttcacgaatttatagaggaggttgtttacatgagtgttattcagcgtatctgtctcgtattaacgattatcggcgctattaactggggactgatcggatttttccaatttgatttagtagcagccatcttcggcggccaaggatcagctctgtcgcggattatttacggtcttgtcggcatcgccggtctgatcaatctcggcctgctgtttaagccgaacgaagaaacatcccgcgaggaagcggcaaatccggaagtcagataaacataaaaaaagcaccgaacatacatatccggtgctttttttgatggttattttttgataaggtctttgcggttggactgttcgatccactcttcaagcttatctttcaatgtgttgaaaccttgcggagcagatgtttcttcagaaacttgtgccgctttcggttttcttggtttgctttcttttctttcaggcgccgcttgagtcgcacggatagaaaggctgattttgcctttttcttcgtcaaccgcaagtacttttacttgtacttcgtcaccgatagaaaggtgttcattaatgtcttttacgaaaccgtgagtgacttcagaaatgtgaacaagtccttgagtttcttcatctaatgcaacaaacgcaccatacgcttgtaatcctgttactttaccagtgtaaacactgcccacttcaaattttgctgccattcataacaactcctaagttaaattaaatacagattatacgcaatttaaaattatatcatacaagtttgtttttcgcaaagagaacttttttacatgatcatgtttaagcacagataaagggggtatactatgattacgaaggctttctagtattccccccttttatttggatgcgaaccgggttcgtatctttttttatgcccttttttcaacaaaccgtttgattctgacgagcgcttcctgaatctgctcaatggatgtcgcataggaacatctgatgtagccttcgccgctcgggccgaatacattccccggaacgacggctactttttcttcaatgagcagctgttccgcgaattcttctgaactcatgccggtcgattgaatggaaggaaaggcgtaaaacgctccgccggggtggtggcagccgagtccgatttcgttcaatgtttccacaatcaggtttcggcgtctccggtagctttttttcattctttcgacgtcttcctggccgtttttcagcccttcaagcgccgcgtactgagccatggaaggcgcgcacatcatcgcgtgctgatgaattttgagcatggcatccctgatcacgggaggcgccgccgtaaatccgagtctccaccccgtcatggcaaatgctttggagaaacctgaaatcaaaatcgtccgctccttcatgccgcggatggcccccatgctcgtgaaaggctcatcatatgtcagttcggcataaatttcatcggcaagcacgatcaagtcgtgtttttcagcgaaagcagcgatggattcaagctcttctttcgaatagacggaaccagtcggatttgacggcgagcatagaagcagcgcttttgttttgtccgtcagggccgcttcaaaatcggctgctgatgctttgaaaccttttgcagctacagtctgaatcggcaccggcttcgcccccgtcagggtcacgagtgattcatatgcgacaaaacacggttcgggaattaacatttcctctccgggattcataatggcgcggacagcgagatcaagcgcctgacttgcccctaccgtaacgatcagttcactgtcaggcgaataactcaggccgaaccgctgatctaaatagcggctgatttcttctctcagttcataaagacccgcatttgccgtataagccgtataaccctgttctaaagaaagaatactcgcttccctcacgttccaggccgtcacaaagtcaggctctcctactcccagtgaaatgacgccttccatcgtagcagccagatcaaagaatttgcggatgcctgacggtttaatctgctgcacgtagtcagataaataagaagtcttcgtttccatttacggagacaccacgattcttttgtcatcgtctccgctttcaaagactttgccgtcatgcttatattttttcaggataaagtgcgttgtcgtggaaacgacggactcaagggtggacaatttttcagacacgaagcttgccacgtctgacatcgtgttgccgcggatgacgacagataagtcatacacccctgacatcaggtacactgattcaacttcctggaatctgtatatccgttcagcgacttcatcaaagccgacatttcgtttcggagtgacttttacgtcaatcatcgccgtgacgccttccagcccgtcgactttgcgccagtcgatcatcgccgcataatcaatgatgactttttccttttcaagcttttcaatgatgcttttgacttcttcggcgggaatgttcgccattttcgcgatcgtttccgcatcaacgcggctgttttcgtctaaaatttctaatatttctgtttctttttcggtcagcttcatacgtttcacacctttgcattatcaaaaatcttcatgacattatatcacgattttcgacaaatgctaagaaaaacccgaaagaaaccagagctaaaatctgacaatcaaaaaagcctttacattacaacaaagaaaggacggcgaaggctctcatggaagctgtttcaccgattaaacgggccgcgatagacggagtcgagctgtattacgagcattatgaaaatcccggcagacagacactcgtctgcgtacacggttttttatcttcggcattcagcttcagaaaactgatcccgctgctcagaaaccattatgatattatcgccgttgacctgcctcctttcgggcaatcggaaaagtcacggactttcgtatatacttacgcaaacctcgccaagcttctgatcggacttttggaaaagctcggtatcagccgggccgcactcatcggccattcgatgggcggccagatttccttatccgcgtctcttctcagacccgagcttttttctaaaatcgtcctgctgtgcagctcggggtatttaaagcgctcgcacccgtcgattatattcgggacgcacctcccttgttttgacctgtatcttaagtattggctttcaaaagacggtgtgctgaaaaacctgttaaatgtcgttcacgaccggacgcttatcgatcaggaaatgattgacggttacgaaaaaccatttacagaccgccagattttcaaagcgatgacaaggttcatcagacacagggagggcgatttagagcccgaggatttgaagaaagtgcaaaaccccgctcttttaatatggggagaagaagaccgggtcgttccggtctcagtcggaaaacggcttcatgacgacctgccggattccattctgtattcactcgaggatacgggacacctcgtacccgaagagcgcccggagtttgtttcggagcggatttttgaatttattcaataaaaaaaaccggcggaaccgccggtttttaaggggtgcaggagctgctttcttttatgaacagaagctgctcggcggccttttggcagccttcgatcggtagcttttgctcaaatgaagcttcaaagatatcctgaatggctgctgccagcttgtcggcacggtcttcactgtagacggcctgaacgatgtcgacggcttctgtctcataaaaatcttctccatatttaaacgggtcccacttggcaatgattttcatcatttccatgaccgcttggctttcttccattttcatcaccgcttataataaagtttgcaaatctattttatcatagatacactgtgcaaaataatgatactacaggagtgacatacatgaactttgatcttcgagaaaaccgtcttggcacacaatcggtgaaatgggacaaggcggaagcgttattcggcgtatcggatgcacttccgatgtgggttgccgatatggatttccgcgctcccgaagcggtcactgacgccttaaaagcccgccttgaccacggcatattcggttatacgtctcctgacgaaaacacaagagaagccgtcgcttcatggcttgagacacggcacggctaccggcccgatcccgcaagcatcacgttcagtcccggggttgtcacggcaatcagcatggcagtacaagcctttaccgaaccgggcgatccggtgttgattcaatcaccggtgtatacgcctttttatcagatgatcaaggaaaacaaacggcaggttttacataacccattacgggaagaaaacggcgtctactgcatggattttgaggatcttgagaaaaagctgaacgattctgaggtcaagctgatgattctttgtaatccccacaatccgtccggcagagcgtggagccgggatgagcttatgcagctcggatcgctgtgcgccgcccataacgtcaccgtcgtttctgacgagatacattccgacttaatgctgtacggaaagccgcatacgccttttgcttctctgtctgaggagtttgcgcggatttccattacttgtgtcgcgccgagcaagacgtttaatattgccggcattcaggcatccgccattatcgttcccgaccgttataagcgggcgaaattctccgccgcattgcatcagaacgggatttccagcctcaacacatttgcggttgcagcaatcgaagcggcttatacaaagggaggcccttggcttgacgcactgattccttacattgaagggaatatgaaattggctgaggactttttaagaaaagaattgccgaaagtccgcatgatgaaacctgacgcttcctatttgatctggatggatttcagcggatacggattttcggatgccgagctcaaagaaagaatgctcaaaaaagggaaaatcatattagagccgggaacgaaatacggaccgggcggcgaaggatttatgagacttaatgtcggctgttcagccgccgccgtaaaagaagggcttaagagaatgaaagcagcgctctcttagcagcggaaagaacgcctttatcagatgagataagggcgttcgctttagagaaataaatactttttttgccggtaaagatgttataatagattcatatttacataggaaaggatttcgcataaatggagattgtaaaggattacctgcttcacttctcttttattttattccctatttttctctatcaagtcttctggctcagcaagcccgatttgcttgtgccgagagcgaaccgcctgctggtcgccgtatttgcagcgtcatcttccttattatgtacggcttttcccatccaggagcttcattccgtccgttacggtttgcagctgattcccattattgtctgcctgctttattccggtaccgcagcaggacttgccgcaggggcagcatccgttttttttcagctcatatggtttgaaccttccgctctttttttcttatccttaattccttttttaatcatcatccctatccagctccaaacgaaatggccttttttctcaaagcggaagaaactgcttttcgctcttctcatcggctgcactgaaaccgccttattaaccgcatctgtcttcatctattccgcgaccaatattttcaattttcaaaatctatcttccgtttattatgaggcggcagtatccgttttttttcaagtcagcgcccttttgctgtgcatttatttgattgagatcattgatgagaatgcgtccatgcgggcaaggctgattcactcagaaaaaatggccgtcgtcagcgagcttgcggcaagcgtcgcccatgaagtccgcaatccgcttacggtcgtcagaggttttgtgcagctgctgttcagcggcgagcagcttcaggacaaatcccactccggatatcagaaacttgtgctgtccgaactcgaccgggctcagacgatcattacgaattatctcgatatggcgaagcaggatgactatgaaaaagaaaagtttgatatttctctgcttgtaaaggaaacaggttccttaatggagtcttatgccaattttaaatcggtgaccgtgactgttcaaagcgagcctgatttatatgtgttcggcgatgtaaaaaaacttaaacaggccttcattaatctgattaaaaacagtattgaagccgtgccctctgaaaacggccgaatcgaggtctccgtccaaaaacaggaagagatgattctcattcagattacggataacggaatcggcatgtccgatgaagaactgcagaaactcggcaaaccgtattatacgctgaaaacgaatggcaccgggctcgggcttaccgtgacattctcgattattcagcatcatgaaggctccgtctatttcaccagcggcgagtactcgggcacaacggcttcagtcaggcttccggcagctgttcactagccaatcgcgttgatcttttatagaataactagagagaggtgaacgctatgaattcgtttgaaatcggcacaatcgtaaaagggttttataaaacaggagcatacataggggaagtgacagacgtcaggcccaatcactatttagtgaaaattaaagccgttctgacgcatcccgctcaaggagatcttcatcatccgaagcaggcggatgttccgttctttcatgaaagaagagcgcttgcattcggggaacagacaaacataccgcatcagatggtcaaaccgtttgatggcgaagttcctgattatacggcttccttacaagcggcgtctgcccggctgaaagatcagcttacagcggacggctcagaatgggcggaacgttcgctcgccaacttggccgcgttagagcgtgactattttaaaagaacttgacccagtcggcatgattgggtttttttatgtggctcggcgaaacagttcagtcagatcgacgcgatcaccgatcgtcggaggtttcggtttttcaagatattgtttatcccgctcgacaagcttgaataatttgtatgtcgtccgcgcatcatccagcgctttgtgatgcgtgcccgttcctttatcgccatactcttctgccgctttccaaaggccggtcaatgttctgtcgccgaagaagtttttgtattcaagggacagatcccgaagttctcctttgaacggaaaagggatgtggttaaacatgcaattttgcttcaacaccttcatatccatatttccccaggtgacgatcgtgcagtttttatcaggatcaagctcatttaatttgcggatgaattcattaaacgtgattccgccgtccacgtctttttgggtgatgttcagaaaggttttacatcgtttcgtcagctttggaaattttttcggtttgatataactcgaaaacgtttcagtcacttcatcattcaccgtcttgacaatccccgcttcaataatctcgggaaagaaattttgcgggctgtattttccgtcaggcatcgtaaattcaaaatcaataatgagcagactgcgctgatccactttttttacacctgcctttcctccgatcaaaaatgatattttatgatagtatatcagtttcccctctgaaactttcttcattttctaaaaataatgaattttcctatatatgcatcgaaaatacaaataccggattcattcctatatactaatgattagacacacgaaaattaaagaaggtgatgttatttctgtccgtaagaagaacttcgtcgtcatttggattacaaatttctttatttccgccagcatgaccatgattgttccgtttctttcgttatatatcgaaacgatcagcccccattcgggcgggtatgtgcagagatggagcgggtatgtgttcggcgtcacgtttttaatggcgtttgtgatttccccgttttggggcagattcggcgataagcgcggctacaaaaaaattctcttgatcacaggcaccggcattgccgtcagcattttattgatggggtttgtgacatcggtttatcagctgtttgtcctgcggctgcttatgggccttgtaacaggctttgttccgacatcgcttgccatgatttcggcgcagacgccgaaagagactgccgggaaaacgctcggcacactgcagatgggtcaggtgtcaggcactttattcggaccgatgctgggcgggctgctcgctgacagcttcgggtttacgtacacattttttattacgtcttttgttattttcgtatccgtgcttctcgttttatttcaggtgaatgagcagccgctcggcgagaaacaaaacaagcggaaaacctattccagaaaacaggtgctctcctatatttttcaccagcccgcgctttgggcgatgatggtgcttaccatgatcgtgcagaccggcaatttcagcatccagccgctgctcgctttatatgtcaatgagctgcacggacctgttaatttagcctttttctccggaatggcgttttcagcgaccggactcggaagcttattgcttgcccggaaatggggggacttcggcgaccgcttcggccacagccggatcttaatcgtgcttttgattgcctcagcggtgttttttattccgcaggcgctcgcctcctccctctccattctgttagtcttcagatttctgttcggcatggtcatgggcggcacgctcccctgcattacggccgcgatccgcgtcagggcgccgggcagcatccagggagaggtgctcggctataacgtcagctttcgttttctcggaaacgtgctcggccctctgctcggaggtgcggtctcaagcggtttttctatttcggctgctttctacgtcaccgcctttctctttttaataggcgcggggcttttatggatggcgggacatctgcaaaaggatacagcgtcaaacgcgggctgaccggcagcgatcacgatttcttctaaatttaaccttctcgtattcttaaaagaatgatacgatatggctagaaatcaggagaaaagagagtgaccatggtacgtaaaataatcggatggattttgctgctcggcattatcccgttgtgtgcatttacagttattgcttccggcaaagaggtaaaacaaatcaagccttttgatcaggtgctcgataaacatattgatttaaaagcgatcaacctggttcaaaacagttacatgtatgacagggacggaagccttgtttctgagattgtcagcgatcatgagaaccgcgtgatcgtgccctttaataaaataccgaatgaggtaaaacagctgtttttaacctctgaagaccgccatttttatgagcataaagggtttgactttatggggatggtcagggcggccgcctccaatttcaaagatcataaaattgaccagggcgccagcaccatcacccagcagctggcaaggaatgtgtatttaagccatgaacgcaccttcagccgaaaactgacggagctggcctattcctatcagcttgagaaaaaatacagcaaagatgagattttagaaggctacttaaatacgatttattttaataacggtgtatacggtgtcggttcggcggcacaattttatttcagcaagccgctgaaatctctcactttgggagagatggcctttatctgcgccatccctaataaccctacattatatgatcctctcaagcattttgattatacgaaaaaacgacaagtcagattgcttaacggattgaaaaaagcaggcgttatatccgggaaacagctgaaaaaagccgaaaaggaaaagatcaagcttgatataaacgaaaaaacaaataaatatcctgactatgtttcctatgtaaatgatgaattcacacagcttgtttcctcatctgaaggctatgacaaacgtcttgaaaaagcttccggaaagacgaaacaaaaaatacagagtgagctttccgacagagtcagcacattgttaaaagacggcgtgaagatttatacggcgctgaatccgtatatgcaaaaccaagtcgtcgcccaagtgaatcaaaatctgccgtatgcaggcgtccagggcggagcggccgtgattaatcatcagacacatcagattatcgcgctttcaggcgggaaagattatcataaatatgatttcaaccgcgcctatcaagcatacagacagcccggttcatccattaagccgctgcttgattacggaccttacattgaaaagaccggcgcaacgccacacagcaagattgacgcaagcaaattctgcagtgcggattactgcccgcagaactataataaccgcacgtacggcacggttacgctggaaacggcgtttaaatactcgtacaacacaccggccatcagaatcatggaccgcgtcggcgttaataaggcgttcagctaccttgaaccgtttcatttcgcgaagctggtcagcgcggattaccgtctgcctgcggcgctgggcggttttacaaacggcatgacgccgcttgaaatgaccaatgcgtacaccacgttcggcaacaacggcgtttatacgccgagtcacgcgattacaaaagtgactgatttaaaaggaaaaacgatattaaaatggaaagatgagccggcgcaggtattcagcgtgcggaccaacatgcagatcaaagaaatgatgaaagccgtcgtcaaaagcggaacaggaaagaaagcgaactttaaagctccgtacgtcggcggaaaatcaggaacgtcaaatgactatcacgatatgtggtttgtcggcctgacggatgcttatacgatgggggtatgggtcggcaaggatacaccgtcaagcgtcgaataccttcatgacgcaagccctcagctttcgatctggaaaaacacgctgcaggcagcttattaaagataacggaggggatccgctttgaaaccagctcagcttccggaccgcgtgcttttgtttgacggcgtctgcaacttatgcagcggcgccgttcaattcatcattaaacgcgatccggccggcaaaatctcatttgcatcattgcaatcagataccgcccgggagcttttggcatcagaaggacttccgacagaacaatttgacagcatgatttttatcgaaaacgggcggatatacaaaaaatccgcagccgtgttaaaggtttcgcgtcatctccgcggagcctggcggctgtcagcaatttttttcgcagtgccccgccccctcagggacagagcctattctttcatcgcccggcgccgttacaaatggttcggaaaaagggaagcatgcatgctcccctcccctgagatcaaaaacagatttctgccttaacaaaaatggctagcttacacaggtaagctagccattatgctattataaagcttgataaagatgtacaaaataccgataacaaaagtaaaccaaaacagaatctcaagcaatataaaaccgatcagcgaaacaatcgagagtgtcgaatagattctgtacaccatgaaaatcaaataaacgagcgtaacaacggcaaataacgccgcaatccaaaaaccattctgcacgagcgcaaaggaaagaattcctccgcctacataaattaaagagcctaatctgatttttttcagattgtccccttcagggtcatttgtgaaaaacaaaagagacagctctgtcactgtgtttgcaatcagcttcaaagccgaaaaaagcataaaatacacaagggcgaacgctgcaaaaagcgccagtctgatccctttctcagagaaataatccagcatcccctgatacatgccgagcgtctgaagtatcttcatgacataaagcgaggtagaaatggataatgacgaactaaaaagcagaatcgcaacgagcggaaaataacccgtccaataagtatttttcatataaaaagtccctttctgtaatctacctcacttattatggaggacttaaaacacattgacaagataaaaaattccatttttcctcacttttacgaaataagggcctgatcttcacaaacaggctttttcggagtaaagtagaacgcgggaatgataaacgtaaggaaggctgttatgaaaaaaacattaaaattgcaaacccgattaacgatattcgtctgtattgtcgtccttatcgcactttgtatcacctttttcacgatcagcgtccagaccgcagaccgcgtgaaagaagaagaacggacaaccgcgctgcgcaccgcaaagctggtcgcggaaacaccgagtgtcgcgcaggcattgcaaacaagaaaagggctgaaagagctccggaattatacactggatgtccagcatacgacaggaaccgaatttgtcgtggtgatggatatgaacagcatccgcctcacccaccccgacgcaaataaaatcgggaagaaattcaccggcggagacgaacagccggcgttgcacggccatatcaaaacgagcacatcagcgggaactctcggaaaatccatgagagccttcgtaccgatctatggaaaagataaaaaacaagtcggcgtcgtttcggtcggaatttcgcttaacaaaatacaggatgtcgtcagccacagtttgagaccgctttatttcattatctgcgtaagtatttttgtcggcgtcatcggagccgtcattgtcgcccgcaccgtcaaaaacattatgtacggtcttgagccttatgaaatcgccaccctcctggaagagcggagcgccatgctcgaatcaacgaaggaaggcatcctggcggttgacgcgcggggaaaaataaagcttgccaatgcggaagcgaaacggctttttattaaaatgggtattccgactaatccggtcgatcaagatgtgaacgatattctcccgaaaagccggctgaaacaggtgattgaaacgaaaaaaccgcttcaggacagggatatccgcattaacggacttgagctggtctttaatgaagttccgattcatctgaaaggacagaccgtcggagcgatcgccacgttcagggacaaaacggaggtcaaacatttagcagaacagctgtccggtgttaaaatgtatgcaaacgcattaagagcccagtctcacgaattcatgaataagcttcatgtcattttagggcttgtccagttaaaagaatacgatgatctcggcacttacattaaagacattgccattcagcagaagacggaaacaagcgagattataagtgatgtcaaaagtccggttctcgcagggtttcttctgggaaaacaaagctacatacgcgagcagggcgctgatctggacattcagctcggcagcctgattccgaatgcggcggatccggccgtcatccatgagctcattacgattatcggaaacctgttaaacaacgcgctcgacgcggtggcgcagatgccgaaaaaaaacattacgtgctcgatgcggtttcaggatcgccagcttgacatagagattacggatacgggagccggaatgtctgcggcagaccaagcccgtatttttgaacaaggttattccacgaaagggacaaaccgggggttcggcctctatttcacccagcaggcaacagaaaatttaaaaggccatatgattgtgacaagtgaaaagaatgaaggaacgactttcagtcttcgcattccgtatgaaccgaaggaggaaaatgatgattaatgtactcatagttgaagacgaccccatggtgggtgaattaaataagcgctatctcagccagattgaaggatttcagctgaaagggatcgcatcatcctttcaaagcgcgctgcacgtgctgagcgagcatcatatcgatctcatccttcttgacatttacatgccgggaaaaaacgggcttgagcttttaacggaaatccgcaagcagaatgaatcggttgatgtcatcgtcatttcggccgcaagcgagctggacgtcattaaaaaaacgcttcggtacggcgccgtcgattatttaatcaaaccatttgaatttgaccgctttcaaaccgctctttccgactacagacgcaagcagaaagtttatcaatcacacagaagcatgacacagaaagaattggatgccgagctttttcaaaagaaagaagcggcggaaaaggttcaccttccgaagggattgacaaagagcacgcttaaactcatctgggcgagcattgagtctttcggcgacggctcttttaccacggaagatctcgccaagcatactgaaatctcgcaagtctccatccggaaataccttaaatttctggaagacatacaagtgctgaatgtagagatggcgtacggcacgatcggcagacccgtctttcaatatcatatcaacaccggcaatgtcagcagcatcaaacaatatttataatgtcaaaaagcgccgtttcgctgtgaacggtgcttttttactgtcatatcccgtgacaaaaggcttgagattcctttttgatatgctatataaggataatgacccggctgatcctcctctgttttaaccagatgaggaagccgattcataaaattgatattttttaaaaaataagcaaatttctatttatttatggcgggtaaaatgataaattatgattggttagcagatcttttcagataagtcataagtcccgaacccggaagagacagccgctcaaggcgggaaaaagagagacgtctcatcattattatcagaaagttttttcgattctgcatccggcacggggactcaagtctgaattgaacggcacagccatattttacaggggggttatatctttgaaaaaacgcaaaatcggaatggcgatggcgctcatcgcagcggccggaaccatattaagcgcatgcggttcaagtgacaaagcaaacggctccggcagcaaaaactttaccgtcggcatggtaacggatatcggcggtgttgatgacaaatcatttaaccagtccgcctgggaaggcatccaggcattcggaaaagacaacgggcttacaaaaggcaaaagcggttttgactatcttcaatcaaaatcagatgcagattatacaacgaacttaaataaattagcgcgggaacactttgacctgatttacggcgtcgggtatctgatgcaggattccatcagcgaaatcgccgatcagcgcaaagacacacattttgcgatcattgacgccgttgtcaaaaaagacaacgtggcgagccttacatttaaggaacaggaaggttcattcctcgtgggagcggccgctgcgctatcgagcaaaacgggaaaagtcggattcgtgggcggaatggaatctgaattgatcaaaaaatttgaaatcggcttccgcgcgggtgtacaagccgcaaatccgaaagcgaccgtcgaagtgaaatatgcgggcgggtttgacaaagccgatgtcggcaaggcgacggctgaaagcatgtacaaatcaggcgttgacgtcatttatcacgcggccggcgcaacgggaacgggtgtcttcacagaagcgaaaaatctgaaaaaagaagatccgaagcggaacgtatgggttatcggtgtcgataaagaccagtacgcggaaggccaagtcaaaggaacaaaatacaatgtcactctcacatcaatggtcaaaaaagtggatactgccgtggaggacttaacgaaaaaagcgagtgacggtaaattcccgggcggcaaaacattaacatacggtttggcgcaagatgcagtcggcatctcggatcacaaggagaacctttctgacgatgtcatcaaagcaacagacgattggaagaagaaaatcgcggacggactcgtgatcccttcaactgaaaaagaattgaaatccttcaaggctgagtaagaaccaggggataaggagactttcgtgcttatcccctctcttttttgaaaagagcggtgaaggaaaagctgcatctcttgcagcttttcttttgccaagctctttctcatcaaagtatctctgaaaaggagcgacaaatcggtggattatatcattgaaatgcttaatatacgcaaggaatttcccggaatcgtcgccaatgatgacgtcacgcttcaagtgaaaaaaggcgaaatacacgcccttctcggtgaaaacggcgccggaaaatcgacactcatgaacgttttattcggcctgtatcagccggaaaaaggcgagatccgggtgcgtggcgaacgcgttcacatcaacagtccgaacaaagccaacgatctcggcatcgggatggtgcaccagcattttatgcttgtggataccttcaccgtctcagaaaatatcattctcggaaaagagccgaaaactttcggccgaattgacagacagcgcgccgcccgggacgtgcgtgatatttccgaccgttacggcctgcacattgatcctgaagccaaagttgccgatatctccgtcggtatgcagcagcgggcggaaatattaaagaccctctaccggggcgccgacattctcatttttgacgagccgaccgcggtgctgactccgcacgaaattcaagaactgattcagattatgaaaaatcttgtcaatgaaggaaaatcaattatcctcatcacccacaaattaaaagagattatggaagtctgcgaccgtgtcaccatcatccggaaaggaaaaggcattacaacacttgatgtcgcacatacggatcaagatgaactggcaagccttatggtcggacgcgaagtgtcattcaagacggataaacagccggctgaaccgaaacaagaagtgctttcgctttctgatgtaacggtgaaagacgcgcgcggcgttgaggcggtcaaacagctctccctctctgtcagagccggtgaaatcgtcggcattgcgggcgttgacggaaacggccagtctgaattaattgaagccattacaggtctcagaaaaacaaatgccggcacgattacgttaaacggcaaacagctgcaaaatatgccgcccaggaaagtcactgaatccggaatcgggcatattccgcaggacagacataaacacgggctcgtccttgattttccgatcggagaaaatatcgtgctgcaaagttattaccaaaagccctactcttctttcggcatattaaataaacacacgatttataacaaagcgcgaagcctgattgaagaatacgatgtcagaacacctgatgaatatacgcctgcgcgcgctctctccggggggaatcagcaaaaggccattatcggccgggaagtggacagaaatccggatcttttaattgcggcccagccgacgcggggactcgatgtcggcgcgattgaattcgtccataaaaagctcattgagcagcgtgacgccggtaaagcggtgcttctgttatcttttgaacttgatgaaataatgaatctcagcgatcgcatcgccgtcatctttgaaggcagcatcatcgcaaacgtcaatccgcttgaaacaaacgagcaggagctcggacttttaatggcgggaagtaagcaaatggaggcggggaaaacacatgattaatcgactttctcatctggctgtgccgctgattgcgatcatccttggattagctgcgggtgcggtcatcatgctcgccagcggctacaatgtcgtaagcgggtattcggctctttggagcggcattttcggtgaagtgtattacatcggggaatcgatccggcagattacgccatatattttgtccggattggccgtggcattcgcatttcggaccggcctgtttaatatcggggttgaaggacagctccttgtcggctggaccgccgcggtgtgggtcggcgcttcctttgacgccccagcttacatccaccttccgctttcgttattggcggctgcggctgcgggcggcatttggggcctgattcccggatttttaaaagcccgtttttttgtccacgaagtgattgtcacgatcatgatgaattatatcgctcttcatttaaccaattatctcatttccgatgtcatgacggaccaccgggacaaaacagacaaaattcatgaaagcgcgtcgctccgctcgccgtttttagagcagctgacagattactcccgccttcattggggcattctgatcgctctgtttgcggcagtcctcatgtggtttatcattcataaaacaaaaagcggatttgaattccgggctgtcggctttaaccagcacgccgcacaatacgccggaatgagcgtcagaaaaaatatgatgtacgccatgatgatttccggggccttcgcagggcttgccggcgcgatggaaggactcggaacctttcaatatgcggcggttaagggcgcctttaccggcgtcggcttcgacggcattgcggttgcgcttctcggcggcagcacggcaatcggcgttgttctggcggcatgtcttctcggcggccttaaagtcggggcattaaatatgccgattgaatccggggtgccttctgaagtcgttgacatcgtcatcgccattattattttgtttgtggcatcaagctacgccatccgtctcatccttgataaattgaagaaaaagggggcgaagtaagtggacttcctgcagattttatccattattgttccggcaacactcgtatatgcggctccgcttattttaaccgctctcggcggcgtgttttctgaaagatcgggggttgtcaacatcggtcttgaaggactgatgattatcggcgcctttacaagcgtcatgttcaacttatttttcggacgcgagcttggcgccgccgctccgtggctcgctctggctgcggctatgattgccggcggactgttctcactgatccacgcggctgccgcggtttctttccgcgccgatcagacggtaaccggtgtggcgatcaatatgctcgcattaggagcgacactgtttatcgtcaaactgatttacggaaaggcgcagactgataaaatcccggagcccttttacaaaacgaacattcccgggttaagcgatattccggttttaggaaagattttcttttcagacgtatattatacgtcgattttagccatcgtactggcctttgtttcctggtttattttattcaaaacgccgttcggccttcgcatccgttctgtcggggaacatccgatggcggccgatacgatgggaatcaacgtgttcggcatgcgctatatcggcgtcatgatcagcgggctgttcggcgggctcggcggcggtgtgtatgcttccacgatcgcgcttgatttcacgcactccaccatttccggacaaggctttatcgctctcgccgcgctggttttcggcaaatggcatccgatcggcgcgctcggggctgcgctgttcttcgggtttgcgcagagtttgagcattatcggctcgcttttgcccctgttcaaagacattccgaatgtatacatgctgatggctccttacattctgaccattctcgcgcttgccggcttcatcggccgcgcggatgcgcctaaagccaacggcatcccttatattaaaggaaaacgctgattgccacacaaaaagagttccgcaccctggtgccggaactcttttcatctatatacgattctgatatactcacgcggctgaaacggcgtttgcattgattcagccgcactcagcttgtcttctgcgtattccgcacccagaaaaaaatgctcccaatcatctgcttccgtctgctgccgcgttttgcagaaatcatcaactatgaatgttcctgcaataatagaacaaaatattccaatacaggccgccgcctttctcttcatctgaccagctccttttgtaaagcttgatctgaaaaagaaatgtatatacaaagatccggatatttgataaatttattttgggttcaaaagaccacaaaaacacaaagaggaatacattatgccgtagcagggtaaaaaaaagtgcgatataatttgtactgggtcctatgaccgtgaattgattgattcattcttacataaagcagttgcttgatgaaaaaacaagcaaaggaggtcttctgttgcagctgttacatttcgcgattttggcgccttttttatttgcatttatcgttccctttctttataaacgggtaaaacaagtccatacaggctggtttgtgctgatagtgcccgttgtgctgtttgtttactttatcagcaagctccctgtcacaatggctggagaaaccgtccggtatgcggccgaatggattccgtccctcggtattaactataccgtttatattgacggactcgggctgttattcgctttattgattacgggcatcggctctttggtgacgctttacagtattttttacttatcgaaggacaaagaaaagctcggccctttttatgtgtacctgctgatgtttatgggcgcgatgctcggcgttgtgctcgtcgataacgtcatcgtgctttatatgttctgggagctgacaagcctgtcatccttcttattaatcgggtattggcataagcggaagaaatcacgctacggggcggaaaaatcactgctgattaccgtcggcggcgggctgtgcatgctcggcggctttatcctgctgtatctgatgacggattctttcagtatcagggaaatggtcaaccaggtgcatattatcgcaggccacccgttctttattccggcgatggttctcctgttattgggggcctttacaaaatcagcgcagtttccgttttatatctggcttcctgatgccatggaggcgccgactcctgtcagcgcctatctgcactcggctacaatggtgaaagcgggtatttatctgattgccagattcagtccggtttttgctttttcacccgtctggttttggacggttgcctcagtcggtctgatcacgatggtatgggcttcctttaatgcgattaaacaaaccgatttaaaagcgattctggcattttccacagtcagccagctcggtatgattgtatcgatgctcggcgcaggagccgccgcgcttcattatgagcattcagagtattttacggcggctgtcaccgcggctgtgtttcacttaattaaccatgctacttttaaaggaagtttattcatggcggtcggcattatcgaccatgaaacgggaacgcgggatatccgcaggctcggcggcctgatggcgctcatgccggtaacgttcaccgtttcactgatcggaacgttttccatggccggtctccctccgtttaacggctttttaagtaaagaaatgttctttacaagtatgctgcggattgctcatgcagatattttcagcctggatacgtggggcgtgctgttccccgttctcgcatggatcgggagcgtcttcactttcatctacagcatgaagctgtttttcagaacgttcagcggcgcgcgcaaaacggatcagcttgaaaagacgccgcatgaagctccgctcggcatgctgatttcgccggtgattcttgccgcttgcgccgtcagtctgttttttgccccgaacgttttgtcttacagcctgattgaaccggcgatgaactccatttatcccgctctgttaaccggcggagatacattccatgtccatatttcccagtggcacggggtgacggctgaggtaatgatgaccctcggcatcatcattgtcggcacgatcggttacgtaacgctctctaaatgggagcgtctgtacggtctgtttccgaaaaaactgacgctgaacaagctttacgatgcggtgacgggcagtatggaaaaaagatcttaccagctgacgtcatcttatatgaccggatttttgcgggattatctgctgtatatctttgcgtcgtttatcattctcatcggagcggcgttcgtcatgaaaggcggcttttccatgacagcgaaaggaatggctgagatcggcctgtatgaaatcgtgctgtccctcgttatggtgagcgcaacggttgcgactgtgttcgccaaatcacggctgacggccattatctcactcggtgttgtcgggtacacactcgcgctgtttttcgtgattttcagagcgcccgatctggcgctcacgcagctcgtcattgagacgatatccgtcgccttgtttcttctttgtttttaccatctgccgaaaatgcggcggaaaaagaagacaagaacattccggatgacgaattttatcatttctctcggtgtcggcgttatcgtgacaatgctcggaatcgcgtcttccagcgaaaaaacaaaagacagcatctcctcctttttcaccgcttacagccataagctcgggggaggaaacaatatcgtcaacgtcatcctcgttgatttcaggggatttgacacgatgtttgaaatcacggtgctgtcgattgccgcactcgggatttacggcatgatcagaacaaaagtaacagaggagggagaaaagcgttgagacagccaaaaacaaacgacatcatccttcagacggcaacgaagcttgtatcttttatcattctgcttttctctttctatttatttttatcggggcataacgcccccggcggaggatttgtcggcggactgattacgtcttcggccatcgtgctgctgcttttggcctttgatttaaaaaccgtcaaatcgattttgcccgtcaattttatttatgtggcgggcgcgggtctgcttatcgcgattgcaacgggtgcaggttcgttcttattcggagcgccctttctcacccatacattcggccattttcatctcccggtgctcgggaatacggagcttgcgacggccactttgtttgatttaggtgtgtatctcgttgttgtcggcgtgacgatgaccattattcaaacgattggagaggaagaatagtggaaatcttaatgtctgtcattgccggtattttgtttatggcggcaacctacctgctgctttctaaaagtctgctgcgcgtgattatcggcaccgcgcttttgagccacggcgtccatttgctgctcctgaccatgggcggactgaaaaaaggcgctcctcccatactgggcggaaaaagcacgtcctttgtcgatccgctgccgcaggcactcatactgacggcgatcgttatttcgttcggcgtcacgtccttcctgcttgtgatggcgtttcgcgcttatcaggaactgaaaacggacgatatggatcgaatgaggggaaatgatcaacatgaataactttgtgatattgcctattctggtgccgctgcttgccgcagtgctgctgatttttatgaacaggcacgtgatgctgatgcggatattcagcactgccgcttcctgtgtctccatcgtcatcagcgccgctctcgttcagacggttttcacacacgggattcagacgctgacactcggcggctggaaagcgccgtacggcattgtgctcgccgcggatcagcttgccgcactgcttgttttgacaaccgccataatcgggctgctcgtcaccctgtactccttccgctccatcggagaaaaaagggagcgcgctttctattattcaggggtgcagtttcttctggccggcgtaagcggagcgtttttgacgggtgacctgttcaacatgtacgtcttttttgagcttctgcttatcgcgtcctacatgctgatcgtgcttggcggaacgaaaattcaattaagagaatcattgaagtatatcgtgtttaacattgtgtcatccgcgttttttgtcatcggtgtcggttacttatatgcggtgacgggcacgctgaatatggctgatctaagcgtaaaaataagcgaatcgggccagaccgggctgataaccgtgatcggcgtccttcttctcgtcgttttcggtttaaagggcgggatattcccgctgtatttctggatgccgggctcttattacgccccgccggctgcaatttcggctttattcgggtctcttttgacgaaagtcggcctgtatgccattttaagagtattcaccctgatctttattcacgatacgggctttacccaccaattgatgatgtggcttgcgatgctgacggtgctattcggcgtaatcggatctatcgccttttcggatgtcatgaaaatcgtcatctacaatattattacagccgtcggcgtgattttgttcggcattgccatgaacacgccggcctccattcaaggagcggtttattacttgattcacgatatgctgattaaaggagcgctgtttatgcttgccggcacgcttatcgcattgacaggcactgccagcctgcataaaatgggcggactgatcacccgttatcccgttttaggatggatgttctttatttcagccatatctttggccggcatcccgccgttcagcggatttgtgggcaagctgaagatcgcggaaggcgggttcgataagggggaaacattgttttccgtattgattcttgtatcaagcctgcttgtgctctattcggtgctgaaggtttttacgacggctttttggggcgaagaaaaagaaatccccggcgcaggcggacggtccgcaaaaggacttctttatccggcagccgcttttctccttttgtcgcttctgttcgggctcggaaccgaatgggtttcaccgtatgtcaatcagacggctgagaatctgctgaatccggaaaaatacattgaagctgttttgaaggagtagatggcatggcttttcaactattattaaacgttcttctcgctgtttgctggatgtttctcacaaacagcctcagcacggcgggttttataaccggatttatcgcaggcttggcggcgctgttttttttccggcgcttcttctcgcggccgttttacatttggaaaatatggtcagtcatcagactggtgctgatctttataaaggaactatatttggccaatgtcagcgtgctgaaaaccgttatagcgccgaaactgaacatccgcccgggcattttcgcgtttaagacggaattgacggaggattgggagatcacgctgctctcgctgttaatcactttaacaccgggtacgctcgtgatggatatctccgatgaccggtcgattctctatatacacgccatggatattgaagatgcggagaaagcgatccacgacatccgcgtctcttttgaaaaagccattcaggaggtgagccgctgatgtttacgtttattctgcaattatcactcggcattatggcggtttcgactcttctgtacgtcattcgcgtcatgaaagggccaacgataccggaccgggtcgttgcgcttgatgggatcggcattaatctgattgccatgaccgcgcttgtatccattctcttaaacacatcggcctttttggacatcattctgctgctcggcattttatcgtttatcggcacgattgcctttgctaagtttttggagaaaggagagattatcgaaaatgatcgaaatcgttaaatgggccgtcgccgtttgtattctgatgggatcgctgatctgcctggtcgcgtctttcggcacactcaggcttcctgatgtgtatacgcgcgcccacgcctcttcaaaaggctcgacactcggcgttaatttggtattgctcggggtgttaggctacttgtggatgctgaccggagaaatttctgtaaaaatactgctcggcatcatttttatcctgctgacggcgccggtcggagcgcacctcatatgcagggccgcgtacaattcgggagcggcgcttgataaaagaagcgttcaggatgattacaaagggatcagaaactttgtgatcaaacgaaaagaagattcatatttgtaaaaacaaacagccggacgattcagggttccggctgtttgtttattttgttataacagccagcgtacagcgggaaacacagatcagcctttctcgttcatcgaaaatgttaatcccgtacacaatggttgccctgcctgtgtgaacgggttccgctatcgccgtgaccgttccgccctctttcacggactttaaatgattggcattaatctcaagcccgacacacgcctgtttcgaccggtcgataaaatgctgggccccgacacttgcagcagtctccgccagcgctgctgatgcacccccatgcagatatccgaaaggctgcaccgtcctcttatccaccggcatcaccgccacgcatctctccggcgtgttttcagtgatttcaataccgagtgcgccgagcaatgtattgttcagattcataggtcattctcccttcaagatttatagtacgttatctgacttggcgatcagcaccgcttcagttcgggagccgacattcagcttattaaaaatggatgtcaggctgtattcaatcgaccgcttgcttaagtgaagcgcatctgcgatttcctgattggtcaaacctttttcgacctcttggagaatatggcgctctctcggggttaaccgatcctgctcactttgaggggaagaagacgtttttgttttttgctgggtcatcagctgtttgaaataggagaaatcaactaaaatctgtccgttgagcacgtgatatatgtattgcatgattttctctttagattcggttttgctgatggcgccatgcaggcccgcgcggatggattcttcaaaataatcttcaacctcatagcctgtgtagacaatgattttacagagaggattctcttttaagattttcttggaaagctcgatgccgctgatgtcatcacccagatttaaatccattaatatgagatcgtaagctgaaaaatcgtgccggagaacgaattgttcactggcatcaggactgaggcaatcgacagaaagattcgtgtccgtttccagaatcgtcttggtgccctccatgacagccggatgatcatcaatcactagtatctttttcatggtttcctcccttttactcactcatttccattttattaaaaagacttggcttctgccaagtcgatttggtgataaaatggttacaattccatttcaatatccgctttaaaaccgtttccttcacttgtgtcgattttcatccgtccgtcaagcgcacggacgcgctccttaatacccgaaagacccatgctcatcgactgtccgccgccttcttcctgattaaagccgacaccgtcgtcttcataatgcagaatcactttattttgaatgctgatcagcataatcagcacctcattcgcctgtgaatgcttcatggcgttcgaaagaaattcctgaataatgcggtacaaattcagctgcgtatccaaatccagcgccgccgtaaaccggcccgtattcagacggatatgaaacggcgcacgctcctgctgctgcgcggcaagcttggataccgccttgaccagacccaaatcatacagcagctgaggccgaagctcatggcacgtctcccgggtcatcaaaatgacatccgacatctgctcattcatctgatgaagcttgtcctgcacctctaactggcaaggctcctctttcttaaaatcggccagaaacagctcacactggcgcttcaaagaaatcaaatcctgcagcactgaatcatgcagatcacgggccaaatccgaacgctgcttttcctcgatcgtaaacatcagctttttgagccagaccgggtttgagccttgttgtttcaggtcttgtaaatggttcatgagttcttcgatctgcaatatgttttccatcgaaacacttgtataaaaagacaatgtctttaaccaagatatctcatctcttgtcagtctcggagtattaatgctcgacaaacaaagcagaacgtatgagtttgcccctctttctccaatcttcatcagaaaaccttgatttacttcaaaaatcttgccaatctctgatgagactttaacaaattcttttttatacggctgccagttcggttcactgttctgtttatcaaaatacagaatatctccgtcagaactgatttcaaagatatatgccttactgacaggcaacacatctaatatcgtctttttaagattcataaacacttggtttaaagctgatacgcttttaagaagctgtgtatatttaaatatgctgtcttgataattatatttttctgaaaaacgtttcaggcgaaatttgtagtctaataactccttaatataaaataccgctaaaaaaatcaaaaatacatatacagtgatttgaataatgttaaagttattccccttgctgtcgaataatatattcagccatacaactccaatagtcggaataatggaaaggaaaccatagtatctaattctgcccaacaagaagtctatatcgtagattttattgaccacgaattgatagactaaagctaatggaataattattaaaaatggtgccgtaactatagcagaataaatatactgtccgaacaacacctcaggtataatataaaatactgtaaacggaaaaaaggctatggtattagatataagtaatactttcagcaaataaaagtgatccttttttcggtagactagtccataaaaaataatggatgtatagacgaccatcatttccaaaaaaaatgttactaaattaatattcgtaacaagttggaaggcaaaatgcttctggaatatctcgattattatattaataaccggcaatatatagagagtagacacaacataaccagctgaaaatttcaattttaattctttaaagtattgatacaaaaagtgaaagtataatacaggtacgttcaaaaatgtaaaaaggttaatatatctgtttatttcatatcctctagttactccacctgcgcttaaatatgcaatggatgtacacaataaaaaaataatcaaaataaaggctgaataagtatcttttactctgttaactttataaatataaaaaatgcataacatgcttaaagcaaataatatgcatgggataatatagataaaaaaactataagagctatttaaggaaataaactcagtattatgtaagtctattttactattaccccttattattttcatatgttcagctttcgctagatattgacctcttatattctcttctgtcggtgtttttccgcttatttcaattatcctgtctccctcttttaagcccatatatttaccatacgtagacttggagagttttacaacctgcaattcatggttattgttttcaaccacataggttcctaccaaaattccgttttgagtaaaatatataatatgagcgacgtaaaagagactgacgaataacaatacaatcgaaaaatttctaatgaattttttcaatagatctcactctctcaatcattgttcccaaaaaattcccctgcatttttttgattgacttaagtccctttcaaaaatctcaacaatggcaggtaacagtttatccggaactcctattaaactagcttccccacacgctaactttgtaagtacaagtggattttccataagataatgtacgatatcttgcttcactgtaatttcctccattaaagttctaacattatatttaaatcttttatacttgtcgtaatttcttcctcgtacattttaattaacattgaaacatactggctaactcctgcatcaaatagtaggtcttcaaggctttttttattatcaatgaggaatgaatggtaacttgcttctgcattcattaaatccaagattttttctgaagcagcattaaatcttcgctttagatacaacagaattaatgtttttcttccctttctgatatcactacgatttttattaaaaagaccataataatcattttcaatctgtttaacaattccaattttataggaataattctcaatttcttcgttaaactccccatttgcaagcattgttcctaatacagctgacattgcagtaagcgagcctgatttttgtttaatcatttgaagacattcgtcttcagtttcggggaaattttcgaggtcattatgctgaccttgcattgcatttaaagcatatttcatagcaagccggggaaaatcggagttcgttttaagctcacaaatcacttgaagacttattgaataaagagaagtggctgcatttaaagagatagattgatctatcttcatccattccttatccaagttatcttcatcctctatatcgtcaaaaatatcaaaagctaaaattaacaattcaattcctgaagctaataacgtaatatccgaataatgctcaccatcgaaagccacataatgcttaaatgcaagaacaccaaaagcaaaatgatttttttcatttataaaagtctgaagggtgtcttttaaatgtggattatttattttctcctccacaatttccttcatcttctctttaatcgtttcggcatctaaacacatttgctcaataattgtcttcaccctcccattctattttactaaatgcaggtgatgaaagacagcaggtttttcgttttttaacaatcgtataatactttatccatgaaatggataaaaaatgcacaaaaaaaagacttgtttccaagtctttttaagaaattttcattgcatatgagaatttatcgagctgatcaatgcttttgttaatgtttcgtaatgagtcggttgtttctctgatatcattttcaagtcggaataataattgctttacttcttctaatttgttttccaccgtttccacactcctttttttgaaagatcaatgaattgtgtatggtgaacgagtcctaggtatttgatctgttactaatagtgtaaacgtttttgcgggatttttcaccgaaaagtatgtgtaaaagtatctgcgtgacaccgcaaaccaaggtaattccatagtcccgaacagggcatttagcgaacaggactatataactaccgcaaaggcagacgtttaggataaagcagaccaatctggcggttctgctgttttttcaacggttttccgacaaaccggcagggactatagtccctgccgtcacaatttcaaaacagaatgggcaaacagcgtcgcataaccaccgacaaacaccgaaaagaccgcaacccccgcattgtggtctttttgcatgtcataactcattatcacgccgcctatactcatgtataacgaatgttttctcaggaaggaggccgccgtatgcattatgtgtatccatgctgccctgttttcgccgcgccataccggcatccagcgcccagtgccccggttcacgcagatattttgacagcgtccgcaaaagaagctgcgggcatgctggaggatgcgcgcctgctccttgcgcggctgtcggcgtcaaaagagcttgcgcgcagcatcctcaccgcagcgcaatcatctgacaccgcagcggtcaagcggctcattaagcagaccggcatcaaaaatgactttgacgtgacgtataatcccgacggcatccgtgtcagtctgatcagagagcaaagccggtttatcatcgccctcagatggtcggcttaaagcggctcaatcgatcagctgccggcaccattcgatcgcctgtaagtaacattcatacgcttcttctttgttcagttcttttccccactcgtcacagtcccagttgttgcattcaatggctttgacgagcgcgagcatcttataataatcgttttcataaccgagcagcgcctgtccgacttcatcgattaaaggcagttctttgatgatatcctccagttccctgtggagaagcgtatcgatgagcgaaaacatgccgatcagcatgtaagaagagggctggggccttccggttcttttcgccagcagttcgcacagtttggccctgattaaggaaatcttaatgatttctttttggcttgagtggcttttcgccgttaaatctctgaatgaaagaatgtaaatcaagcgcttaatctcattcagcccgagcatcatgatggcctgctggatgctgtctatcttttttttcagccttgtttgcgatccgtttaaaaaacgcagaatctgatacgataagctgacgtcacgctctatgtattccgtcacgcgctgtatattaggctggtcattgtttaattcgcttaaaagctggtagtaagaatgaaaatgaaacgtcagatcatttccgctgatgacacgcggttcactgaaaaaatatccttgaaacaggtgaaagccgtctatggccgcctgtttataatcttttctcgtctccactttctccgctaaataaatcagacttttacagctgtacgtctgaatgatttttttgcgctccagacgcgaggattgcaaaaagtcgatttttaaaatatcaatatatttcatcagctgttccactaactcttcattttccggattgatggcgtaaaaatcatcaagtgctaatgtatatcctaatttcttcagctgtctgcatcttgagatgagcgccggagtgatcggtatgtcctcaagaatttcgataataagctggtcaggatcaaaggaggtagggagatctgaaaacatcaggctttctgtaaaattcacaaagcagcgtttcccctcagtcagcttttcgattccgatgttgataaagctgttaataatgagatccgtcgtagctttatctccatccgcggccgaataacggttctcttcgctctcccggtaaagaagttcataagcaacaacctgttcgtttctgttgaagataggctgtctcgcaacaaacaccttcattcatttacccccttagatgcggccttcgaacataagtatatcaaataacttgacgaaatttgtctaaatgtgaaaaatattatcacaacaaaaaagcctttccagagataggaaaggccgctttgttttctattcaagttcccgtttcagcttgcttttgatttcatgaatccgctgcatcttgttgctccagcagtcttcgcttaaatcgaccggatattcttccggcttgctgatccgtttgtattcctcccacagaagtttgaggttatcctgcacgtattgctggatgtcggtaatttcgggattatcatagcataaaacgccgttttcaaagatcggctcatgcaagtctttcgcatagaagtcagtgacgaatttgctgacgaacgtgtggacgggatggaacatttttaagcgtttctgatcatttacccgctcgtcataaagcgcgatataatcaccttccgagtggtgattcagcttgttgataatccggtatactctctttcttcccggcgttgtcactttttcagggtttgacgaaattttaatggtgtcggtcagtttgccgtcctcttcaatggcgacaagcttataaaccgcgccgagagccggctgatcgtatgcggtaatcagcttcgtgccgatgccccacgtatcgattttcgctccttgggatttcaggtttaatatcgtgtgctcatcaagatcgcttgaagcaatgacctttgcgtctgtgaaacccgcttcatcaagcatttcacgcgctttttttgacaggtacgccaagtccccgctgtccaggcggatgccgatgaagttgatccggtcgccgaattcctttgcgactttaatcgcattcggcatgcctgaacggatcgtatcgtacgtatctacgagaaatacgcagtctttgtgggtctccgcatatttcttaaatgccgtatattcatcgcggtacgcttgtacgagcgcatgagcgtgcgtgccggataccggtatattaaaacgctttccggctcttacattactcgtcgcgctgaagccgccgatcaaagccgctctcgctccccacatggccgcatccatttcatgggcgcgccgcgttccgaattcgagggcgtcttcatcaccgacaacgcctttaatgcgggccgctttcgtggcgattaatgtttggtaattcacaatgttaagcagagccgtctcaatcagctgcgcttcaatcaggggtgcttcgacccgcataatcggttcattgttaaaaacgagctcgccttctttcatgctgtaaagagatccggtaaaagaaagatcccgtaaataatcaatgaaatcatcagcatagtgcaattccgtttttaaataattcagatcgctgtcggtaaatttgaagttctccaagtattcgattgctttttctaagcccgcaaataccgcatagccgttttcaaagggaagctttctgaaaaaaagctcaaaaatcgcttttttctcatgaatgccgtctctccagtacgtttcggccatattaatttgataaaggtctgtatgtaaagacaaactgtcgtctttaaaaccatgctccaccaaaattgttttccccttccttactctgccacttgcgctccgatgctgttcttaaaatgggacagggcccattcatgcccttccggattaaagctggccacagcgttttgatgaatgacgatctgaaagcccttgttgtaggcgtcaaccgccgtgtgaagaacgcagatgtcggtgcacaggcccgcaagatgcagctcagtgatctgccgttcccgcagtttcagctctaaatccgttcccgcaaaagcagaatatctcgttttttccatataatttacgttttttgcgtgtttatgtttctcataaagaggcgatagccttccgtacagctctttgccctccgtgccgttgatattatgcggaggaaacaggcgtgtctcgggatgaaagtcatcgtctgcatcatgcgaatctaccgcaaagacaacgtaatcaccgttttctataaatgcttgcgtcaaactgacaatcgtatcttcaatctgtctcgcgggttctccgcaggttaatgccccgttctcagctgcaaaatcattcgtataatcaatgcatataaatgcttttttcatagccggcctccccgccattcatatgaaaaccattatatcctatctccacttgtaagtgaattggcattgtaaaatgacaaacagtgttttgcccttttaagatttcaggagtgagcgctgaaaaatgtcatcctgcacgtaaatgccgtcaaggttcacggcataatcggcggcaaaaaccaggccgagcggcgtttcgaattgaaggtccgagatgacggagcttcggacaccggcaagtgcggcaagcttcatatatggtgaataagcatgatacgggagccttccgtttatatagagcaccgcgtcttttcggcttttcagcgcctgtttcacttcttcatacggctgcttttgcagcacctgtcccttcgtcagggcaatgatgactctttcacgcagcgagcctaaaaataaatggcgttcatccggtttcgtctgcaaagggccgtacatcccctgctgtaaataaaggtcaaccgttttgtcgctcatcggcctgtccctcccagcttgttttacaattatcgccccggacgggacgcggtaaaccgttttcgttacatttcagccacccaatgggagatcttgccggcgagctctccggcgggttcttcttcaatcagcttgctgaatgattgtaaaagccgctgcgccagcgcctttttctcttcctcataggaaatgatcgtgctccactcaagttccggaacggctacaagggtatgctgttcttttttattttcatgcagatatacatcaccgatcattccggaatgcacggtaatattcgcttttctgattttcataaaacattccccttttataaagactgattctattatactacaaaaaagcgacagcctcctaaaaggaggctgtcacgcgttaaaccaatcaggttcgtcaaacacatcgatgtcttcaaagcgcgttttgctgaatttattagtaattttgacaaaatctccggaatgaaacgcccctgcccccgcgcctgagtggtcaacggctttgggagaaatggcaaacacgtcaccgaagctcgccgcagcgtctccggctaaactcataatataaatcggtcccacaattgcaggcatacccacacctccgcttttctttacagcattttatgcgctgcaccgggagttgtgcccgtttttatttcggcttgcggctgtcttcgagctttgaccgctgacgaagtttgataagccggacgatatttaagacgaaagcttttaaaaccgcgtaaaccggcacggccaggatcattgcgagaatgccgccgaaactgcccgctccgataagcagaagaataatggtgagcgggtgggtattcagccgttttccaatcacaagcggagaaagcaggttcccgtcaagctgctggacgacaacgacaacaataacggcaaacagcgccttagccggcgaatccataaacgcgataatcaccgcgggcgccgccccgagaaacggccccaggtacggaatgatattggtgacggcgatcaccatcccgagaattaacgcatacggcaggccgatgatccaatatccgataaaacatgccgttccgacaaagagacaaatcagcagctggccttggaaataggcggccaatgtgacatataagtcgttaaatattttccgaccttccgcccggtaggaagaaggcaggattttgaccgccaagagcggaaaccgccggccgtccttcagcatataaaacaaaatgaacggaacggtgatcacgacaagcgtgatattcgtaacgacgccgaacacggccgacaggcttgccgtaatattttgcggaaggctttgtaaaaatcccgtcagagactgctggattttttctatcgacacataatcctgcgtcatcatccacgtaaaccatttggaatgggataattgcgccgtcaagacttgaatctgatgaatgtaatcagggaaattgttaatcagccccgtgacctgggaagccacaatcggcccgatggcagtgaacataaaggcaatcagaccgatgaaaacgagataaatgagcaggatcgccaatgtccgggggatttttttctcaagcaggcgcacgatcggattaaaaatgaaaaacaaaatgcccgagatcaaaatcggaaaaaacagagtggtgataaaaccgaaaaacggctgaaatataaacgagactttcgttgatacgtaaataatgagcaaaacgagcaaaatttgcagcgtccaaaaatggacctttgatttcaacaagcggtttcctcctattgtcgtgtgaacttgtactgtgattgtaccaaaaaaagccgccgtgcatctatgtatctcaaaaaagaagacgcaccggggttctatagtgccgcctccggtttgcgccttttcgggctgttacacgcgttcggtataatcaggcatgacggaaaccacatggcggtttctgatataaaatacacggtcatgcgtctcttcaattgcgatgtgatccggagtggcatcaatcagccgtcctctgacaatgcgtctgacggtttgaatgataaaccttgagccgataagcttatggatggtctgataaacgtaaggatccactaacgagacgatttgcgggcttccttgatgggccattttcgctgatcccctttactatgttttccttcagcatatgcagcggacaaaggctttgacacagtacgtctatcggagcggaaaaggtgttagtgagcatgcggagttatgtaagcggaaaaggccgcatgagtggcctagactgagcttcttatgggatattgggctcggtcaattaactgatcaagcttttggatttgtttgagcgcggccgtgtgatccatttggcggtaatggtgatgtccgccgggttcttcatcgagttcatccgcttgtttcacgatttgctggagcgtattcttgtccagttcgccttcaggcagataggaatcggtgtgaagcagaatcgccagcgcaatgtccttcgccgctttcggttcttcaccgagccggatgagcagcttatgcgcccgttccgcgcctttaatggcatggatatcatttcttctgtacttttcataatcccatttgccgtctgtgtaccattcataatggccgacgtcatgcagtaatgccgctttcgccgccagatccgggctgacacctgcttttacggcaagacggtatgcatgaaacgcgcaggcgatcgcatgggcgacaccggaacgctgtaaatacttttgtgcgattggatgggtgaagacatccattaacgttacatttctcatggaaacccctccttcatatatttttagaatcctaacataaatcgagaagaaactcaattcatctgatacatttcttataccccttatatgttgtttcattcatcatatgccgccggacccctaagtgattgtacaaacaaaaaagagcagcgtgaaagctgctctacaaaaattctttgatatcgtatatccgtccgttttccggctcgcccgcgatcagtgagtgaatgacgccggcgatgtattcaggacttctgaggtttttcgtttctttcagattgcggaaccgttcgatgtcatggaaatcttcttttgacgaagaacggatgaccgactgcatgtctgtatccatcactcccggcgagaatgatatcatgcggaccggcagctcttcatcttcctgttcaaacccgaatgttctcgtaaacatatcaagccccgcttttgagctgcaatacgcgctccagcctttataaggatttttcgccgcgcccgatgtgatgttgacaattgttttgctgccgctgaacgcttcgaaacgctttgtgaacatttggctgagcaaaacgggcgccgtcaggttaagggtgtaatggcggttcaattcttcggcggaagcgtctttcgcccgcttgatcggttccaccattccggcattgttgatcagtgtgacggcggagtaccccttctcctctgcttgatcaagaatcgccttcatctgccgcccggtatctgcgagatcggttaaatcaacactgtattctgtcagcccctcgcgcttttccccgcttatcgttcttgaaagcgcggcgacttcggctccttcttgaagcgcctgttccgtaagcgcccggcccaagccttttgacgcgcctgttataagaaaaaactgcatgaaactcctcctttttttcttattttacgggctgtcttcccgcaaacacaagcgatccgttttaccgctttgccttttcctgcgccgtgactttcgggatcagatagatcattgccgcaatcccgaggaggatcaagacggcataaatagcaggaagcagataagaagtctttttctcttccatttccatatctgccgaggtatgccgcaccgccggctcggcaaatgtgatacccagttgtttcgattgcgctttgatcgtattcggctccgtgtctgacgatgtaaacaaatttgatatcagtttgtcatccgggttttcggccggctgatcaaacgtgatatccttctgttctttcggaagcgccgttttttcctcggagtaggcatcgtcgtgcaggtagtccgtacgaatttcaatgtctttcttttcatattcattcggcttgacatcagtattttcctcattcgcggctgcggcttggggaaggaaaaggaaaaaggagagagcaaacagcagcaatcctttttccatgaacgtgttacgcctcataagactgatcactttcctccgttttttccgcaaacagccgaatgacgagcggaagcgccgccgcaatcagcgtaatgatcgcaagaaccgttacccccaacgcaaacagatggcccgttccgtattgaatatcgatatagactttcgaaaccggactgtcaaaggtgaagttcggcataatcaggtcgatcaaaggcgccacataaaagagaatgagcgctgatgatgcgatccatccggtaattgagctgaagacaaaggctgcccggataaaagctgaactcgccgcaagcaggagaatcgtaaagactgaccatttaatcgtctgatcatccggaagcgaatagatattcagaccgaacagactgatcatcaatccgaccataatgtttaaaatcccaaagagcgcgcctttgacaagaagcggcgcctgctgataatacgagctgaaatagccgatcagaagactgctgatcaggacgatcaccaaaatgacgaccggcggaacattctgaacccggtcttccggcacctctccgctgattttaagcggattggcgagataatcataaacatatccgttttcctgtccgtcaacgagcgcgttccctaaaatgccgtacacgtcatttctgatcaatttcgtggaatcgacgtttttgccccagttgctgttcagggtgtccgctttttgctggacgtcatttacgctttgctgcatattgtcggtatagctgatgatgccggactggcgttctgacagatggcccatcgtgtcagacatttgcaggacttcacggccgacggtatcctgagcgccgagcgccatcgttccggttaatccgtctccgctgaacgcggccgcttcctgcacagcgccttcagccagctgatcggatgctttcgccgcgctgtctgaaatgctggcaagctcatcgagcaccccggcttgctcatctctgatatacgagctgtagttatccgagaattcggtcatgcctttaatgaaattgctgatgtcttcatcagtctgcattttgttgtttttcagattttcccagcttgccgtttcttccggtttgatggcaagaacggtttggacttcaccttgctgggctttcagcacccggtttttcacatcaggcagcgagcccgcgtcaagagagtgatagagtgtcgcctcatacagggataaatcattatagtaactcattaaatcggatatcttttttgtattgatgtcagcggcaaacatctgttcaagagcagatttgcggccgctatccaatgacgggtagttcagaatgttctgttctgttcttacaatcattctgtaaacggtatcgaagtcttgttttctcgtttcttccaattcttccaaattttcctttaatttatctgcccgtttttcaactttggcaatctgatttttaaggccttggatttcttcatcaagagcatcgagacgttttttcagttctttattatgagtctgctgtttctcttccagctctttttcaatttgctgaatgcgttctgcggcttggttcagcctttcttttgcctcagatatgtccgtgccgccgtccctttcagaatcgtttggatcgtccgccggctcatcagcaggcggagtgacgttttcagcggctgtcgaggtctggacggtttttggctcctgatcgcctgtgttatcggaggcaggctgctcttcttttgtgccgtcttccgtttttccgtcttctccgggagccgttccgttattcggatcggtatcgccggagttttcaccgtcatcgccttggcccggttcttccggttccggtttttctttttccggttcttttaatccgtcagaaatgtgattgatttcagcggagatgcgttttaattcgtcacgctgatcgtcaaggtcaattttcagatcgccgggtttttcttcttccggtttttcttcttctttcggttcatccgagccgtcatcacccgggtccttttccggaacggttaatgccggccgatcccttttcataagggtttgaatgctgttcaatgtttcaaatcttgcttgcgctttatattgagtcaaataattgtccagtaaattggattgaatattcgccatcccgcgttcctgatcaggaacctgcgcttctctcacctgttgggcggcaaaaagagccgatcccgtctggtcaagctgtgtctgcgcccggtttatgcctgaagagagcccgctcatcatcgtgctgaactggttggcggcctgctgtgctttaatggcgttcagtccggttgtgatttgcttttgattttgttcctgcgcggccatcagcagttttttctgattttcttgatattgtttgtagcgctcgaccgtgtcggcaaagtctttgagcgtggttttggcttcatctgccgaagtcagtttttcttttgccgcgccctgcgcttcattcattgattttttcagttcgtcaatcaggtctttttgccgtttgatttcacctgccaagtcattggagctcggcttgtaaaagttgtacatgacattttgaaactctgattctttattgacgatcttgtcaaaatcgcctcggacattgttcactttttgtgagacgaaattccaatataatgccgacatttttttattcattgatttttgggcgtcttcaagctcacgctgcactttttctttgttgacggcgttcaggttgctttgaatattgaatgtcagcgtggctttttgcggacgctccttgtcatagcttaagatgtcttttgaaaaatcggatggaatgtaaacgacggcgtcatatttcttagccgccagaccgttttctgccgcgctcctgttgacaaccgtccatgaataatccggacggccgccgagagcggccgctacttctttgccgaaatggacggattcctcttcctcattttcatctgtttgtaagcccatatcttcattcacgactgcgatttggcgggtggcgttgattttttgttttcccgggtcatcgccgataaaccggaaaaacagcaccggcagcagcagaatgatgacgaccgcggctattaatttgatcaggctttttcgttgttcggtcatctgacggcctccctttccgctgaacataaaggtatttggattttttgctccttcccgttttcaaccaaatagccgaagcccggctgaatgtccggttcctgcctttggtaaggcagcggaatgacattttgttcggattttttcacaagcagcatcgcgtggcggatctgtttcatttccgtcgttaaggaatcatagccttttgagaattcgctgtgattgcccgccgggataaaactgaagcccacatgcgcgtaagatttcataaacatcgccagcttgtcctgtaaggcggtgtcgatcgtctgctggaatcttgtaatgccgtcggccattaacacgaccggagagaaactgagtttgtgcacatcgccatttttgacggcctgcgtatactgagcttcgcgctccgtgaaaatggcttctgccgtttcgatccactgccggacgtcttcttttgtgtccagatagctgacctttgtttcctgcgcatactgcgacagtccgcggtcaatcgagtcaaacagcccgacccgttccgcaccttcacgcagcaggtgattcagcatcactttcaggatatttgtttttccacgctgtgtctggcccaaaataagacaatgcttatttttacccagatcaaagtacacagggctgaccttttcctcatgaagcccgacaggaatgcggaacgggtcttgttccgggccgagacggagtgaaaattcgccggccgtcagcatatccggaagcatcggaatcgggtctggtccggctgttccggcgtggcgctcagctaaagctttgacatcagctttcagcgcctggaacatctcgaggtcattttccgcttcagccggaagaaacatttgcgcgaaatacagttcttctttttggatcatgacgcggcccgggatcggttcgagactgaacggcggacgcccgtaaatggagtatccttctgactgatccattaaataatggacgactttcgtttttatgttgtttaacagcgactggcggacggcgtttaccctcgttgcggtcagcaggaagtaaatgcctaagctttgcccgtcgcgtgaaatctggataaattccgtttctaattcatgcatttcgtctttgacgatgtcgaaattgtcaattgtgataaatataaacggcagctcttcttcactgagcgaattgtacattttgatatggctgacttctttttccctgaacagccgtttccgccgctcgatttcttccttgatgcggatcatgaatttttcgatctttctcatttgatccattaagaaatagtctgcggtgtgcggaagctttgccaatggcagaagcgtgccgtttccgaagtcaaagatgtacatatgaagctcttccggcgtgtatccttccgcgaaattcatcaggaaggtgatggcagccactgacttgccgtagccggatgagccgaaaatgccgatgttgccgtcatccatcattgtgtaagcgagaggcgcctgtctttgctgatcaggctcatcaacgcaggcgatgaagaagcggtctttttcctgcgcggggtaaagcgtgcgcgggatacgttcggcaagcggcggaagccacgggctcggcagcttttcaatgcccatttcattttgaatccgctcgatttcttcgactacggcttctatttctgccggggcgtcttttttcgccgcatcatccgcatccacctcagacagcggaattaagccggtatcggtaacgatggcaatgtcatcctcggtgccgtatacatcttccatgtaaggggcgccgctccaggcagactgaaactgctcatacacttcgttatttccgacttgcaagtagccgcgtccggtgaccgtaatattcgccgcatcactgtttttcaggatttctttactgtcacttgcatcctgcactttcagcgcgaccttaaagcgtgagttgctccatatttggtcgtcaatgatgccgcccggcttttgcgtggcgagaattaaatgcacaccaaggctccgtccgatgcgggccgcgctgacaagctccctgataaagtcaggctcttcgcttttcagctcggcgaattcatctgaaatcaaaaacaggtgcggcatcggaatatccgtttctccctgtttatacagttttgtatagtcattgatgtgattgacgcgatattgatcaaacagccgctgccgttttttcagctcgctcttaatggatgcaagcgccctgatactgaagtttctgcttccttcaatattcgtgatggtcccgagaaggtgcggcattttgcggaacggctgcgccattcctccgcccttatagtcaatcagcaaaaacgccgcttcatgcgggtgaaagtgaacggccaatgacaggatatatgtttgcagaaattcacttttcccggagccggtcgttcccgccagcaatccgtgcggcccgtgcgctttttcatgcaggtttaaatagacgatgtcgtcttttcctttatagccgatcggaacagccagcgattttgcagactcacttgtctcccacttctgcctgatgccgatttcttttacttccttcgcatgaaacagctcgagaaatgagaccgtttcaggaatggaattcgtcattccgacctgatggtgcaatgtccgaagcgtccgggaaaaccgctcgttgtttgtccgttcatgcctgtccagcttaaacgggatctgcaccgcttttttctgttgaatgagaatgtctccctcatcttcattaatgtagcggacgagggtgtgaatgttttctgccaggctttcctttgtttccgcggcaatgatggccgagatgccgagatgctcatgccggccttcgatgtattctaaaatgacgtgctctgcgatcagctgctgatttgtgatgacaaagacaaaatgcggctgaaagatctttttttctttatcctcttccaaatcccgctcccgcagcagctcgtaaatggacgataacaattgatcgcgggtctgttcattgtaaataaatcctttcgcatacatatgaggcagctgaaattgcggcagccacttcatccattcccattccttatattcgtcctcatgaaagataaagacaaatcgcaggtcatggtagctgttgaagaacgcgagctggccgatcagctggtgaatttcatttttgacgatctgaggtttcccgacaagccccatcggcccttcttgtaaatcaacggtcacgggcgcatggcggatgtctttatacacacgctgcatgtgctgcgactgctccatcaagtcatccacatcacggttcgccaggtctccgccgctcattgaaatctcgtagcttgacgggaccgtgcccgttccgagccgaagcatcagaaaatccctgctttccagcgatttctcccaaatgcggccgctgatttcagaagttaaatatttcattttttcaaacgggggaaaatgatgcgtcagcacgtgcagctgtttttccgacagcgtctgaagctctttccgtttgctttctaaatactgcttgtacacacgctcccgtttttcctcccgttttttccgctggtttttttcacggaaatactgcacggtggacgtaatgagagtcatcataaacatcgccaaagagacaaggatgaatatacccctcggctgtataatagcgacaacccccattacaatcagcatgaccacaggaggcagaatgacgagccacagcccccggttattctgttcgctttcctgcgagggaaagctgaatgaaacgcggtcttcgggaagatcgtagaccatgcgcggcgttcttcgatattgcgggtatttctttttcatttcggtgcttggttttaccgttttggttaaaccggtttgaagcttttcgtgatgaacgatttctaaaaggtcgtcctccgtcagcctcacacgcagaaaattccacagcagctcatctcccgtccggagcctttcgggagcttctgcaagctttccgttcacataaacttcctgaccatcagggacgacagaccagcatcctcccgacttacgcagataaaaagtccctgtttgagcggaggacggctctttgtatatatccgcttcctctgtttctgatgagaaaacgatctcatccttcccgccgataaaatacacggaggattcttcctggtcaggggtgagcagaagccgcagcgtctcttcttcaatccggcagggcatttcatttcctattgtcaattcgccggcacagttatttcccaggaaaacatcataacgatctgtttctttccgataaagggttgcggcgttttgccgtaacggaagtgtgccgaccgtgattgtatctttcatatccggaccgatcgtaatcggctgagagggcgggagttcagacagctgaaccttttgtacgtgctctcggtaaaagacccataacagactcatatggcgaacctcctgacgacagcctgatcgttacatgcggccatttgatgtgtgctgttattttttttcatcttttttctcatctttcttgtcgttctctttgttatctttcgctttgtcttgtttgctttcatcctgtccggcggaagcttcggcggtgtcactgttttcctccgcttctttatgctgctcctccgcctcttttttcgccttcgcaagctcgctttccacggcgtccagttctttctgcttttcgtcgtctttcatactgtcatccgctaataattgctgtttatattttgtaagtccgagccagatgtacgggttgtactcaagattgcggccgattttgatggcttcttcattttcccctctgccgatatcaatccaataaaggaagtgcttcgggtctgattgcagcgtgaccagattcccgatgtttttccgctgttcttccctcagattttcaactgccacataagaggaagcaagctcgtactgcacagattccgggaggctttccgcatcgtatttagcgagtgtgtcaatgactttgctgtactgctgatttaaaaaatagcggttgctttccgtaattgcctcttgcttcggctggacgaaaaacagaacgtataaggagtaaagaagtgccggcacaaggaggacggcaagcgccagaccggcgtatctttggattttccatttctttttcggcagttttatgtatgtcttgtccctttcttcgagggaatcgattgcggtttgaatggcttcttccagttcttcaatcgtctccgcctctaacacgcttttcacctcaggagagaaatgaagcgtctccttgtacttcaaatattcatcgaaggtgtacgccccgtcagctgcaagcgccgcacaggctttgagctcttttaacaccctttctctatcttcctcataaggcggaaggctctcctttacgccgtaatgaagaaagtaaggcgtcagcgctttatcaaacacgatattttcaggggcggcaatcagattgagacgtttcagcttatgctgtttcacggcttggacgagacggtaggcaaattgccacctgctttttttatcttttccttttatatagcggaaagcctgataagaagaaggaggtttgattgtgatggttacttcgtcttctgaaactgagacctctttttgaaaaaaaggatcggcatctttaatcacattcgcttccagcccgtcaagaagcttgattttttcccgctggaaggtgaacgtgaagcctgtttcggtttcttcccggacggcgtctaattctgtttctaaataagatctgttatgacctgtcattccaccatgtcctttcataaaatttcaaggcggtctccgttcgtaatgccgcagtcagatagcttttgttctccggaaaaaaccgtttctttattgaccactctgatccaatagccttcacgcggcggaacggatacatgctgagcctgccgggcaatatcaatgacttttttcacagaatggtaatctgacaatctgagatcgaagacgctgccgttataatgtgttaaatctattgtaatatcgatatacatattcatatcacccttacatagaaagagcgccgtcttcttgattgaatcaggcgctccgtttcttcattcatcttattatccgcgaatttggttagcgatatcttggtcggtagactcaagcgtatttgccgtttgatcgagctgatgattcacatcttgaagcaattcagacattttaataaatgaaggtttcagctgctcatattgatccgcgaatgcttcacttgaagcaccttcccacatgcctttcaaatcagaaatcatgcggttcaggcggtcaacctgattcatgacttcctgactttcaacgccatattgcttagccatcgctcttagctcttcgggtgtgacacgaattaatccagacatattccttataccctcctgtgtcatcagcctaaatatgggctaattcacttattttttgaacgtcattattataaaaacaaccaatcggcacagtcaaacaaatctgttttaattttacaaaatgagtcttatgatatattggatttttcgtcataattacacattttgtaaataaaatagtatgattttcttattattttcgttttcactgaatgatcttattgtcctagtctatttccctgcaaagatgcctttcagtctgaaaagcaagatggtaagatcaagatatgaagctatgaaaaagtagggatacagatgaccaatccaaaagatccatttaagtacagtttcgacaggcttgaagatgttgccgaccatatcagtgaagttcttcaatgccccattacaatagaagacgttaatcataaactgcttgcatacagcacgcacagcgattgtacagatcctgcccggacgtcgacgattatcgggcggagggtgccggaaaaagtcatcaacaaactgtggaaagacggaaccattccggcccttttaaaaacggaccagccgatcaaagtgaaagaaattgacgaggtgggcctaagcaaccgcgtggcgatttccatctggaaaaacagtcaggttctcggatttatttgggcgcttgagatcaaaaaaaagctcaatgacgaagatctgaagacacttcagctggcagccaaagcggtgcggaacaagcttttgcacctgcagatccgcaaaacgaaaatcgaagagcggggccaggagtttttttggaaaatgctgaccggccatatttatcaggaagccgagatggccgaagggtttcataagctcggaatggcgctgccgtccgtgttcagcgtcatgatcatccgtttacatgatgagctgactgaaaagacggaacagcagctgcaatatttgcaggaaacgacacagcagattcatgtcatgctggcgactgttgattcaaatgaattaatcttattagccgcgccgaaaaccgatcagccttttaaagatttaaagcacttcgctcttcatattcaaaaacagttgaaggaacgatataaaattgaggatgcgtcgattgcgatcggcggtatttacgaatcgatttcttacgtttaccgatcctatcaggaagcgctttccgtattaaaagcgaaagagcggtttgtgagagaaaccaaacaccttttcagcttttctgaactcggcatttatcagtaccttgatgtgttggatgaaaaacgcaagcacagcggctatatgaactattccctgtcaaagcttgagcagtatgacagggagcaccaagccgatatggtaaaaacgctcgaacattttattgatgccgacagcaatgtcaacaccgccgctaaagcgcttaacatccatgtcaatacattgaattacaggctgaaaagaatcagccagatcgcagaaatcgacttaaaaaatgtgaatgagaagtttacgatttacctggatatcaaacttcgcagcatgggttcgtgaaatttcacaaatccgtgtttttttattttctgtttcaaacaaagaattttcgcaaaaatcgcgctacacttgaagcatcacacaaacattgggggaaacagacatgattatcggggttccaaaagaaatcaaaaacaatgaaaatcgagtggcattaacacctggaggcgtttcacagcttatcggaaacggccatcgggttcttgtggaatccggagcggggctcggaagcggctttacaaatgaagattatgtatcagcaggggcggaaattctggaggacagaaagcaagtatgggatgcggaaatggtcatgaaggtaaaagaaccgctggctgaagagtatgcgtatttccgtcaaggtctggtcttgttcacttaccttcatttagccgcagagccggaattagctaaagcgcttacagaaaaaggcgtgacagctatcgcgtacgaaacggtaacggacggacgttcccttccgctgcttacgccgatgtccgaagtggccggcagaatggccgcgcagatcggagcacagtttcttgaaaaaccaaaaggcggaaaaggaattttattagccggcgtaccgggtgtatcccgcggaaaagtcacgatcatcggagggggcggcgtcggaacaaatgccgcgaaaatggctgtcggactcggtgccgatgtgacaatgatcgatttgaacgcagaccgcctgcgtcagcttgatgatattttcgggcatcagattaaaacattgatgtcaaaccctgtaaatattgcagattccgtcgcggaagcggatcttctgatctgcgccgtgctcatcccgggagccaaagcgccgactctcgttacggaagaaatggttaaacaaatgaaaccgggttccgtcattgttgatgttgccatcgatcagggcggcattgtggaaaccgttgatcatattacaacccacgataatccgacttacgaaaaacacggcgtcgttcactacgctgtcgccaatatgccgggcgccgtaccgcgtacgtctacgctcgcattaacgaatgtaaccgttccttacgcgcttcaaatcgccaataaaggcgcggcacaagccattgcagacagccctgcgcttaaagcgggcttaaatacggctaacggacatgtcacgtatgaagcggtagccaaagacttaggctatgactacgtgcctgctgaaaaagcaatgcaaggttcggctgcaaaagcttaatagagatgaagaggacagcctgatcagcgggctgtccttttttctttctcacaaaaggaaaaacggccccctgtctcgaatatcaattcatatcccggaagaaaaaggaggattcatatggctgttcagcactatggtgtactaaaaggcgctgtgttagatatgaaaagggaaacagatgatgattctccgcattttcaagtcgaggtgctaggcgagcctgatacgcgctatcgctgtgcgatcaatgtcatgtcaagttcaaaagaatcagaggtgctgtatgcggcacgcgatcattttgacgcaagcgcgatcaccctgctgccgaacattccgtacggatataccccaattgatgaaaccagacgtgagctggcgctggattatgtccgcggcggattgtttgatccccggaacatggtgccccttccgcatgaagtcaccgggccggataatgacttaaatgactttattgagacgtacatgcaaaaagccaaatcagaaaaagccaccgtctatatttacggctctaaattcgggccggagccgggcgctgataagattttcgggttcaagccgacaaacggcatgcataatattcatatgaatcagggaaacccaattgatacacgctggaagaaggataacggaacgtggcacgacggcggtattttaatccagtttgcagaccagtgggccgcggtctttttggcttttctgtctcagtcatggtgcacggatgaagaaggccacccttatacattttgtgatcatacacagcttaacggctgatgtccgcataaaaagcctgccgaaataacggcaggcttttcttattacattttagcagcttcggtccgcttcaggctttccggcctcatatcacgccagtttgtttcaatatattcgagacaaacggggcgggtttcattcgtcaggcgggtttcccagccgtccggcacatccagataggccggccacagtgagtactggccttcagcattgacgagcacatggtatgaaccgtcttcccgttcaaatggatttgtcatatcatctctttcctttctttaccggactgtacgccgtccgtttaatttctctgccagaatcgcgccgatgtcggcaagcgggcccggctggcacatatctttatggcggcagtctaagtcataccgctcgatttcccccgtaatatacggtttccaagtatccggctcgatcgggtcaaaccactccggaataatcgtggatctgaagaacagcacatctccgtggaacggcttcggcttgtatgttcctaacagcccgacagaatttacgtacgtgtctttcagattcatcatcactgactcgtccaggctggctaatgcgctcccctcacggcggagaatggtcagcgcggtgtcaaaatcaagcggctgatccccgaggctgtccgggtcgtaccctcccagagcaagcagcgcaatgaccgcttcctcgtcatcaggcgcattttttatcggcagaaaatgattcggatacgcgtcaagcatcaccaaaagcgaaacctcttcgccccggctctgtaattgtgtcgccatggcctgaatgacattccctccgagagaccagccgagcagacggtacggccctttcggctgcacggtgcggattttttcaatataatcagccgccatgtcatctaagctttgcggaagcggttctttttttccgatgcctctcgcctgtaagccgtatatcggataatcagcttctaaagaagacatcagcccggcataacaccagctgagaccgccggccggatggacacagaacaacggtgtttcttctcctgccgttctgagcggaagaagaacatcaagcgcgcttgtgcccgttcctgactcaagtctttcagcaagacttgccactgtaggagcttcaaatagtgttccgatattgagctcggctcccatcgcttcccgaatacggctcattaaatgaaccgcaagcaaagaatggccgcctaaatcaaaaaatctgtcatcaataccgacacgcggcagatgaagcacctctgcgaacagctcacacagcatttcttcctgcggcgttctcggtccccggccggtgacctccgtttggaagtcaggcgcagggagcgcttttcggtcaagctttccattcggtgtcagcggcagttcattcatttggacaaaagctgacggaatcatgtaatccggcaggctttcttcggcaaaccggcgcatgtcccccgtgtccaaggtgctgccggcagatcggacaaggtagacagccagccgtttatctcccggccggtcttcacggacgactgcggcggcatcctcgacatccggatgtttgacgagaaccgcttcgatttcccccaattcaatccggaagccgcggattttaatctggtggtccgccctgcccatataatcaagagaaccgtccgtccgcagacgggctaaatcccccgtccggtacattctcgttcccggcgggccgtacggatcagccacaaagcgttcggcggtcaggctttgccgccctaagtagcctcgtgccacgccccctccggcaacatacatttcgcccgtgatccccggaggcacaggctccagccggtcatcaagcacatatacgttcaaatcaggaatgccgcagccgatgaggctgtttgctctcagttcggcaatgtttttgtctaattcaaggtaactgacgtgcaccgtcgtttccgtaatgccgtacatattcacgagcaccggctgattgtccgcgtggcggctgtaccaatcctcaagccggctcagctcaagcgcctcgccgccgaagatgatatatctgagtgcgagctgacgccccagctctttgtgttctttttccgcatgcatcagctggtaaaacgctgacggcgtttggttaagtacggtcactcgttctttcacgaggagatgcagaaacgcttccggggatctgctgatgtcatgcggcacgacgacgagacgtccgccgtgaagcagcggcccccatatttcccagacagagaaatcaaaagcgtaggagtgaaacatcgtccatacatcatcagaattaaagtgataccaatgccgcgtggactcaaacagccggataacattgctgtgcggaatgatgacacctttcggcacacctgttgatcccgacgtgtaaatgacataggccgggtgaagcggtctcagcggacgaatccggtcggcattctcagggttcgtgacggcatattgccgaagtgtttctttgttctgcggatcatccaggatgaaggccggcatgccgttttcgccagagagcttacttgcgccttcacggttggtgagcataaatacaggcttggcatcatgtaacataaaggcgatgcggtccgcgggataatcaggatcaagcggcaaatacgctgcccccgtcttcaggacggctaacagcccgacaatcatatctaaagaacgcggcagcgccagtgcgacaaactgctccgggccgacgccgcgggcaatcatcatgtgcgcgagctgattggctctttcattcagctcttgataagtgagtccgctctcttcaaatactgccgccgtttcatccgattttgcggcggcctgtatttcaaacagttcaggcagtgtctgccgaggctgaatatgctgttttgcccgtttaaccggcaaaagcttccggcgctcttcatcagtaagaatggttaagcttccgatcggtttatccggatgtgatacggcatcttcgagcagaagaagcaggcgtccggcaagtgcttcagccgtttcttttctgaataagtccgtactgaactccagcaggccttcaataccggcaggcgtgccgtcatcatggcgctgttcagccaattccaatgtcaaatcaaatttggacgatccgacactgctgatttgcaggcttgtttccatatcaggaagactgagtacagggtcaggcgtattttggaatgcgagcatcacttggaacagcggatgtcttgaccgggagcgaaccggattcaattcttccacgagacgttcaaacggcacgtcctgatgttcatatgctgcgagattcatttccctgaccctttcaagaagctcacaaaagttcggatcgccagaggtatcggttctcagtacgagtgtattaatgaacatacccacaaggtctcctaatgcgtcatcactgcggccggctatcggactgccgatcggaatatcggttcccgccccgagccgggtcagcagtgcggaaagccctgattgaagcaccataaacaggcttacgcgctgatttctggcgagtgagagaagacgggcatgaagctcttggccgatgttgaccggaatgacgccgcccctgtagcttgattcagcgggacgcggaaaatcagacggcagctccagctgatccggtacattttcaagcgttttcttccagaaatccagctggcgcgcaattaagctctcagaatcagacgcgctgcctaaaagctgctgctgccaaagcgcataatccgcatattgaaccgccagcggcgcccattctgctttttcacctgtttgccgggcgatataggctatggataagtcacgcatgagcggattcaaggaccagccgtcgcctgcgatgtgatgcaggagaaccatcagcgtatattcgccgtcaccaagatcaaacagctcagcccggacggccggctctttagcaagatcaaaccgatatcttgccgcagcggcaagcatgtcttggagctcgtttttgtctgcacgtgtcactgtaaacacagggcgggcttcttcagcaggtaaaataagctgatgagatgatcccttattttccggaaaaacggtgcgcaggctttcatgacggctgacaacatcgtaaaaggcgtgtttcagcgctgattggtcaagcttgcctgacatgcggacaatcaccggaatgttgtaagtcgggctcggcccttcaagacagtagagaaaccaaagacgcagctgcgcaaatgacagcgggatgtgctccggccggtcaaacggcttgagcttaggccgcgcactctttgcggtgtcaagctgtgcggcgagcccggcaacggtcggggtatcaaacagacgtccgatgccaagctctgcgcccatcgtctcccggatccggctcatcaggcgtccggctaagagcgaatgtccgcccaattcaaagaacccgtcatcaattccgacccgcgcgagaccgagaacctcggcaaacagatcgcataatatttcttcctgcggcgtccgcggccctctgtcagacaggacagctgaaaaatcaggtgcaggcagagcgctgcgatcgagcttcttattcggcgtccgcggcaattctttcagctgtacaaacgcgcccggcaccatataatccggcaggctttcgcccatatattcacgaagtccgccgatatcaaggggctgatccgcgacagcataagccgccaggcgcttatctcccggctggtcttcacggacaataacagcggcctgcgaaatacccgggtatttcgacagcactgactcaatttctcctaattctatccggaacccgcggattttaatttggtgatcggctctgctgatataatcaagcgagccgtcctcacgccagcgcacgagatctcccgtccggtacatcctcgcgcccgcgggcccgtacggatcggcaatgaatctttcagctgttaaatcaggacggttataataacctctggcaagcccctcgcccgctatataaagctcgcccgcaattcccggcgggactggctgcaatgcggcgtccagcacgtatacccgcgtgttccaaatcggctttccgatcggaggcgcccctgtatggtcttttgcaagcggctgtgcggccgaccagattgttgtttcagtcggcccgtacagattcgtcaccgtacagcctgattcaagcagagcatgcataagcgcgttcggaagcgcctcacctccgacaagcacctgcagcgcccggagggaatcaggttcattggtgactaatgaatgccacaatgtcggcgttgcctgcatgattgaaataccgtatgagtgaatcatgttcgcaagcgcccgcggttcctgaatcgtctctttacgtgcgatgacgcaccccgccccgctgatgagcggaaggaagagctcaagtccggaaatatcaaacgccgcagtcgtaacggcaagcaggcggtcttgtgcgccgagcgggaacatttcccgcatggataagaggaaattgcttacgctttttaatgtcacgactacgcctttcggtttgcccgttgaacccgatgtatatatgacataagcggggtgcaaaggcgaacattccgcctgatcggaacagtcagcattttgagcggcaacggtttttaccgtatccgggtcatcgagaatgatcctttttgcatcactgtcttccggcatgcggccggataattccatcgttgtaatcaggcatgcagggtgtgcatctttgagcatgtatgtgatccgctcagaaggaaaatcaggatcaagcggcaggtatgcggctcccgttttcaaaacggccagcatgctcacggccaactcctgtgaccgcggaagcagcaaagcggcaaattgttccggtccgagccccttttcctttagcatgccggcaagctggttcgcgcgcttgttcaattcggcatagctgagctcttcgttttcggtgatgattgccggccggtccggtgtttttacggcctgttcgtaaaacagctccggcagacttttctgcttctcggccttgcgcgtgtcattccagctttccagtacgcagagacgttcactttcaggcagaaggttgagtgtgccgattttttgtgtctggtctttcacagcggatttcagcagaagcaggaatcgtttttgatggttttcaatatcttcggcgctgtacacttccggattcgcatcaaagtccacacgcattccgcttccgtccgctctgtcgtaaacgttaattgacaaatcatcaacgggcccggctgataagttatggacggtgcctggcgctccggcgaaatcaagcgcgtagtcaaacggcatcacattaacttgcgggccgaacagcctgcggttttctccgagcaatttaagatcgcggcgcatgtcttcatggcggtatttctgatggcgccggatgtttcggatttcttttgccacttggctgacggcctcatgaaaattcatatccgggcggagagaaagccgcaaaggcagaagattcatgaccatactcggaatattcagtgaaattgagccgatccgtcccatcatcggtaaaccgagcacgatatcccctgcgtttgtcatccggtggacatataccgccgctgcggctgtgacggcttcatgccagttcggaatcgcttttacatgctgcaaagccgtttcagaaagataagccgtgcttctccgaaagcttgttgacgttctcggcgctctttctgccaaactgacgacatcaggttcatcggcaaatttctccatccaaaattcccgatctttcaggaattgatcagacgcacggtattcttgatcttcttttaccagttcctccaaagagccgaaggagcgcccgttatccggacgtccttcccgtattgcggtgtacatttgcgccgtacgccgtgccagcagtgaaaaaccgtagccgtctatcacaatgtggtgaatgcgctgataccagaaaaaacgttccggtcccgcctgaaataaaatgtcgcggaacaaaggcccggccgccatatcaacgggctcagccaaatctgtctgcatgagtctgagtgcggcctgcttcggatcagcttctgaactcacatctatgacatcgatcgcagcttcaaatggaggattgatgatctgcttcggcccgtctgctccctcttcgaagcgggcgtgtaatgacacggcttccgtcagcacacgttcgaaagctgttttaaatatgttcacatcgatcgcgccgtttatctcaacatactcgcctgtattgtaaatcggattatcaggatcaagctgctgcgcaaaccagataccggcctgtgcgcctgtcagaggcagctgttgtgtatcatgcattctattctctccctttataaataatctgcgttcggcaagactttttgagatcgggaagaaagaagtctccaccactcttcaagcgtcgggttctccgccagttcaacaaacgtcacttcagctccgtcacggcgccattgttcgacaaggctcatgattctgacggaatcaaggcctctgtccagcaggtcttcatgatccggaatatcagacggtgattcttgaagaatcgccgcaatttgttcccgcacccggtcttttgtcaatacggcggaagtcttcccttctccttcagaaaccggcgcgccgcccagcagctccagcacttcgtttgtcaaagccgtgtaagcgcagcgctgagacgcatattcgatggccatcttatgtttttctgaagaaaaatcagcaacggcgtctccgataaagaagctttggatatcatccataaatgcttcacaggctgtgacgagacagccgatgtgtgcataaattcccgtaatcatgagctggtctctgccgctttcacgcatgatgtcaaggagattcgtccgtttaaacgcgctgtatctccactttgtgaggacaatgtcctgatcatccggggcaagctccggaatgaccttttcttcataaggcccgcttttcagccccggtccccaaaaatccgtcagcagcgcgcggtccgccgggtcttggctgcccggctgcgcggtgtacaccaccggaatgccgagcgctttgcattgctcttttattttcttgatattctgagccgcctccgtgatcggagccttccctttctcaaaagcatcgacgaaataattctgcatgtcatggatcagaagcaccgcgcgtttcgggttcagcgtccacgatactttattttcaggcatatctgacgctgtcggcagcgcatatgcgggaatagacggtatagccaatgtaaacacttccttttttaagattgtttgatttcagaaggcttcaatttttgggcgatcgtttcgcgaaggtcctttttgctgaccttgccgacgccggttttcgggaaagaagcgataaattcaacccggtcgggaattttatatgccgccagcccgcgctcccgtaaaaacgctttcagctctcccggtttcggcgcttctcctttcggaatgacgaacacacaggaccgctctccgagaaagtcatccggcattgaaaccatggccgcatcatgaacggcaggatgggccagaaggtgattttccacctcttcagcggcaatcttttcgccgccccgattgatttgatctttcgcacgtccttcgacgatgatatagccgtccgccgtcagtttgacgatatcgccggtctgataaaatccgtcggctgtgaatgatctttcattatgttcaggcgctttataatacccgcgaatcgtgtaagggccgcgtgtaaacaaatgtcccgcttctccgggggcgacatcccgcccgtcatcgtctaaaacccttacctcatcaaaaggtgacatcggtctgccttgcgtattgacaatgatctcttcaggatcatccagtctcgtataattcaccaatccttccgccattccgaaaacctgctgaagggtgcatccgaaagcgctctttacgcggcgggccgcctcagcactgaatttggcgcctcccacctgcagcacttgaaggcttgataaatcatcacttcgcgaaccggatgcgtccatccacaccatcgcaagcggcgggacgagcgctgtaatcgtgacacgttctttttcaattaacgggaagcagtcatccggactcggcgtcggtgacagaacaacacggcctccggcatataaagttcccagcacacccggcgagctgagcggataattatgcgctgtcggcagagcggccaaataaacgctgtgatgatccaagccgcatatttccgcgctgaggcgcaaactgtatatgtaatcgtcgtgtgttcgcggaatcagcttggacagccccgtactgcctcctgaaagctgtaaaaaagcgacttccgccgggcttacctcttccagctgaacaggctctctatgcaggctgctcagttcctgaaactcttcagcttcgccggccacaatgacatgcgccaaatccggaagtttgtctttcacctgtctggcaagcgccctgtaatcaaaacctgaatgcatatcaggaatgatgtatgctttcgcctctgcaaactcgcagaaatacgtaatctcactgcttctatgagaaggcagcgcgaaaacgggcagtgctccgagtcggaacagcgcgaaaatcacttcaaaaaactcagcgatattcggcagctgaacgacaacgcggtcttccttttgaattccgagcttatgcagccccgccgctaaacgatcggccctttcatctaattctttataggtccaatgtacatctttacacgtcacggcagtttgatttccgtataaagccgcgcgctctttcagcattcctccgaacgtctcacccttccagcagccgtcttttcggtatttgtcagcccattcttccggccatggcgtaaatccagtcagcacgatccgtcccctccttttttacaactcatcttggtaaagccccatcgcccggagcatggtgcggaatttcgccgatgtctcgtccagttcgtcctgcggctttgatccggcgacaatcccggcacccgcaaagagccggagagaccttgtttccgcttcggcgcagcgaagtgcgataatccattctccgtcaccttcagcatcacaccagcccgccattcccgtgtagaaattgcggtcaaacggctctatatcctgaatcgcttctctcgccgcatccgtcggcgttccgcatacagcgggcgtcggatgaagagcaatggccagctcaagcgatgtcgttgacggatcactaagctctccctttacctcggtggacaggtgccacatcgcctcagttttaatgagtgacggtttttccggcacatcaagcacacggcagaacggttttagggcggcggccacggcggccacgactacggcatgttcatgcagatcttttgctgattgcagcagttcttccgctcttctctgatcctcggcgggatctgtgctgcgaggtctggaacctgccagcggattggacagaatcgatgttccgtttttggacagcagcagttcaggacttgcgccgaaaagcgtttttcttgtttctgacgttcccgtcacatccgcagcgaatgtatagccgcgcgggttgtgctgcgccaaatgcttgacggcctgaggaatgtcgatatccttttcagcggtcagatgaagcgtccttgacagcacgattttgctgagcggaccgtccgtaatgttgaatacgccttgttccacaccgctcataaagccctcaggctccggaacgggacggatgtcatatgtattggattgcggcttttctgcggaagattccgcaaacgaaagcgggcctgccgtatggacaatcttcggtacaaaaagccgggaagcttttcttccgtcaaaaggaatggcgccggccgcaatcggatgtttgatgccggcttgctttgcctcaagaagcgtctgtctcacacgttcaggcagtgaatccagctgattctccgcgtctgcatccggcacttttgcaaacaaaccttccgcgagcatcgtccttttcggggaagctaaaaagaacgccccgggcttgtaagtatccagcaccttttttgcagccacttccgtcaatacaggttgatttgtcatgtttgtccctccttttcgttacatcaaacgcctaaagtagcgccgccatcaacgcataaatcatgcatcgtgatatggcttgcctgttcagaggccagaaacaaaacggcatttgcaatatcagaaggctttgccagcttttgaagcggaattcccgttttatatgtatcaagcgaacctctgataacgtcctgtgctccgttttcatcccgccacagcgcccgctgcatgtcggtttccgttgaaccgggagatacgatgttgcagcggatatgataggccgcaagctccagtccgaggcatttcgtaaacatggcggcagccgctttcgacgccgcataagctgccatggaagcacgcggaacgccggctgcattcgaaccgaccgttatgatggcgcctttttgacgctccatcatgtaccggctgacagcccgcgatacatgaaatacgccggtcgtattaacagaaaatgtttgatcccaatcttcatcactgagggattgcaccggacccggccgcagcacgcccgcaacgttcgccaatatttcaataggccccatgtcacgttcaacggcagcgatgatatcattgacagccgcactgtcagatacatctgcggcaaacccctgcgcctgcacgcctttttgccgaagtctgtcagttagcccgggaagcaggtcttcatttgtatctatagctgccacatttacgccttgttcagcaagggcaagcgctgttgcttctccgatgccttgagcggcgccggtgacaacggccgttttccctttcattcccaatgcgtccatattatcattccctttctatattgataatgattatcattatcaattatgattcaagacaatcatatccaaatcaaaacacgcagtcaattagaaaattagaatcagccgcatttagttcgaagggcctgttttttctcatgcgggagaatacggggtatgcggccctcccggattcaggcagaaacgcagggctctgctgattaaaacgggcagaacagaaatatggccctctccttcaaactcgctgtattcagcacggactccatcatcttcaaatccggataataaagagtacagcgcctctgcgtgctgcgggattctgcttttatgtgttttttcaatttctcccgcagccagcaatacactgacttgaagattttccgcagagagccggtctgacaaacgttctgcgttttcctgaataaaacgcttgttccaatgaattgacggacttcccgcaacataggtctggaacatgtccggcctcgtcaaaagcacttgcagcacaaaaagaccgcccagcgaatggccgaaaatcgtctgcctgtctctgtcgatcggataatcccgctccatcgcgggctttacttcttcttctataaactccagaaacgcttccgcccctccctgttcgggccatgccgcgccgcgtggatgcaccggcagttctgattcagaaagcggcatcgtaaaatcactgtgccgttcggcggaaaacggctgatctgtcgggtagccgattccgacaatcaccgccggaacaacgcctgttttttcaggccgccggctttgcacccgcaaagcttcggccattgtgccgaacacggaatttgcatcaagcaggtagatgacggggaagccggaggcaggcggttcttcctgaggaaaagagacaaagatacgatacgtacggcctccttttgagcgcatttcttttacttctgtgcccggaactgcgtatcggccggccggcgcgaacccccggtttatttgttttccgtccattatgtgttcatcccctttgtggcaattgctttatctatccttattgataatgattttcaatatcaaaagacacctcaaataataggttttttgccaaacaaagtcaatggatttttgatataaaaaaagcaccttattttaataaggtacctaagaactatatagggataggggcttaatcccatgtaaagcgctcattcttccatggatctcccctcatatggtagccgtttttctcccaaaagccggggtggttttcctttgtaaactgaatgccgcgcagccattttgcgcttttccagaaataaagatgggggaaaacgcctctgagcggatagccgtgctctggcgttaacggctcgccgttatgcgcatatgccagcagggatgtttcccgcgtaaaatcagaaagcggcaggttggccgtccagccctcttcagcgtgcagaatgacgaatcccgcttctttgtgcacacccgctttctcagcgatgtctttggcgcgtattccctgccagatattatcaagacgggaccagcccgtgacgcaatgaatatcatttttcacttcggcttccggaaaggctttgatatctttaaagcttaacagcataggacggtcaacaagcccgtacacttgcagattccattttgacatatcttcataataaggaacatttccggcgtgaagcacgggaaacttcgttgtgacattttgatttggcggaatccgttccgactgttttgtttgcttcgttttcccgaaaaacatatggctccctccatttagtaaacctttattaaatctttgttgacaatcaatcacccttcgattacgctaatctggtacaagtgtaagggggaaaaacaaatgaaacaacgcaaccttcgcgcgggcgatatggcgcttatcggcatgtttgccgccctgatggccgtcggcgccaacattacatcaatggctccttttttgcaagttgcgggaattccgttatcgctgcagcctttcttttgtctgttagccgcgatgcttctcggcgccagacgggcagccattgcaatgacggtatacgcattggccggacttgcgggggcgcctgttttcgctcaattctcagcaggctttgcgccgtttatcggaaagagcggcgggtttattctcgcttacatcccggcggcatttgcagccggatggctgctggaaaaaacaaaaaaacccggccgcctgcattatgcatgggcctctttgatcggtaccgccgtcatttatatcattggcacgacctatacgtatattgcgctgaaattatggcttcatgctccgatcagctacggaatggcctggttttacatgatatggtttttcataaaagatatcgttttagcactgttattggcatcaatcgcgcctgccgtatacaggtctattcataaagcgacggggttcagcagaaatccggcgtaagatgttctcagcatacaaaaaggctcccctttccgggagcctttttttacaggacaagcgcggcaatccagccgaatatcacaagcgggatgttatagaaaataaatgtcggtacgcacgtatcccaaatgtggtggtgctgtccgtcggcgctgaggcctgacgtcggcccgagcgtactgtcgcttgcaggagaacccgcatcaccgaccgcggcggccgctccgattacggcgatcgtcgccatcgggctgaatccgagctgagcgcacagcggaacgaatatggtcgtaatgacgggtacggttgcaaatgatgatccgattcccatcgtgattaataaaccgaccaccagcatcaggagcgcgcctactgattgactgtgaccgataaagcctgttgatgctttgaccaaggaagccacatcgcctgttttattcaatacatttgaaaaaccggccgcaacaagcatgacaaacccgataaaagccatcagaatcataccgtccgtgatcagcttatccgcttcattgcgcttcatgactccgctgataaacagcgtaaacaagccggcaagcgcgcccatgatcataccttccactccgagcacttgtgacagatagagctgaacggcaagcgacacggcaatggagatcagggcgatggcaatgctttttttcgtataaggagaagacgatagtccggcaatctccttcgtctcatatttcttcggtttccggaagacgatgacggctaaaattaaaccgaccgccatcccggccgtcgggatgattaaagcatacgggatatcactgagcggcacctttaaaccggcggacgccatattatctctcagcatcccctggaaaatctgtccgaatccgacaggcagaacgatatacggcgcagtcagtccgaatgtcatcacacacgcgatcagcctgcggtctatttcaagttcgttaaatatctttaaaagcggcggaatcaataccggaataaacgcaatgtgaacgggcaccacgttttgcgagaaacaggatatgattaaaataaccagtacgattaacacttttgacagtgcttttttccgcgaatcttccttttttccgattagtttgacagacgcttccaccattgcatcgggaagccccgtcttcgtcagcgccgcggcaaatgctccgagcagcgcgtagctgaccgcgacggtggcatttccgccgagaccgtccgtaaaagccttcaccgtctctccgaggcctaagccgccggtcagcccgccggcaagcgcgccgatcattaaagctataataatattgacacgcagcaggcttaagacgagcataagcaatactgcgacaacaacagcattcattgatgagtccctccaaaaatcctttagtttgctaatgtagtagataattaaagttaacatacattccgcgctttagtcaactaaagattttggaaatcaaaaaacccgctgcatcaaggcagcgggatgctgttatctttcgggcgtaaaccgctcagtcaaaacagccaacgtccttgccatgacgcctgttgcgccggcagggccgaagcatgtcgctttattcgccgtcgcggttcccgcaatatcgagatgaacccacggcgtgttttccgcgaattcaccaaggaatgcccccgccataatcgcgtggccttctcttcccggagaattgttcaaatcagccatctgactgtttctcacccgttttttatccttttctgtaatcggaagctgccagatcggctcgccggattctttcgccgattccgccacctgttcataaaaagcggcgtgattggtcatggcgcccgtcatttcgttccctaaggcgacaatgacaccgcccgttaacgttgcgacgtctacaaggacagaggctccgtgctgcttggcgtatgtgatgccgtcggcaagcacgagacgcccttccgcatcggtgttcaggatctcaatggtttttccgctgagcgaaacgatgacgtcatccggcttcatagcatcggacgaaatcatgttgtccgtagacggtatgacggcgagcacgttttgttcaggccggagttcgccgataatttccattgcgcccaataccgaggcggcccctcccatatcgcttttcatgccgacgatgccggttttcggcttaattgaatatccgcccgtatcaaaggtaattcctttaccgaccaggccgatgacgtcttcccactgatctttgccctgatacttcagaacgatcattttcggcggttcggatgagcctttgttaacggcaagcagcccgcccatgccgagctcttccatttcatctttttctaaaatttcacactcgaaatcgtattttgccgcaagctcagcggcatatgacgccaaatcagtggccgtcagcatattacccggcatattcacaagcgtgcgggctgaattcgtcccttggccgtatgccgcgccgacgttcaggccggcctgcacttccctcaggtcttcttcggtcacggcgcagactgatttcagttcctgatccggctcattcgatttatgtttataatcctgcacctcataaaccgcaagcagacagctttccgaaagcgcatgagcggcatcggcggcaggcacttccccggagacgaatgtatcgagcaacacggatacttcctgttttttatcttgatgaatctgctgaaatactcgtgcaaagcattctttcgtatcttcaaacgaataatccgcttctcttcccaggccgataaaataaatacgtttcataccggtcgcagccggagggtatacttttgatacacgattgcgtttggcggacacatcaccatcctttaacagctgggtcagatgaccgtctaatttatcatccaattccttcgtaaatccgttcagcgtgcttttttgaaaaagaccgatgaccagtgtttcgggatgccgcagttgatcagatgcataaaacatgagtacacactccttatgtgggtatttgttatgtaaagtggtataatgaaaaaacatttttcattgattttattttaccaaactaagggcgttttctgcagtttttcgatacgatcggaatcagcagatacagaaaggatgtcgcatatggatgtacttatgaattttcctttactggcgagttttgccgccattatttttgcccaagttgtaaaagtgcctattcaatttatcgtatccaaaaaacttgactggtctcttgtgacgagcaccggcggcatgccgagctcccattccgccgccgtcaccgcgctgtcaaccggaatcgctttggaacagggactggactcgcccctgtttgcagtcgccgcgattttcgccgtcattacgatgttcgatgctacaggtgtcaggcggcatgcgggtgaacaggcgacagtcattaataaactggtcatcgactttaatcggtttgtcagcgaagcgaaggactttcagaaagcggaagagaaagaaaaacagaagaaactgaaagaactgctcggccatcagccgattgaagtgttcttcggcggcgtcaccggtattgtgctgacattgattttagattatttctttatgtaaaaacgcttcagcggatgctgaagcgtttttattcttttaccgttttgtattgatttctgaacacttgcagcgactttgtttcgttcagctttacaagttcgtcctcggtcactgtgccgttcccttttttaataatgtagacctcaagtgtttttttgccccaattgttatagacgtccttgacggtgtcaaagtagaggtcaaggcggctgcctttaatttttgagccggtatcggcgacaaccccgtaaccgtaattcggtataaacagaatcgtcccgatcgggaaaacagacggatcggccgcaacagttgaatataaatcgcgtttgaccttcacacctgaatatgtaattccgtactgcgggtgacccggagattttccggtagattccgctccggcggtataaccggtggccgtcaccttttgtgacggatagcgttcccagtcaaaagcttcttccagcggctttaccctgcctgatgccttcttttccggctgattctgtaaggattgaaacggagtgccgatgtttttcaaaacggcgccgcgatgttccgtcatccaatttgtcagatcctttgcttcaacaccggttatggaaaagtatgtcgcatggcatgcgcccaaaaagagcacgatcatgaatacgcgtctgattatcgtcaatctgaaatcactctcctccgagtcattgttcccaactcggtgaggtgctatacaaaagcgccgcgacacaaaaaaagctttcttgaataagaaagcggcttaaaacatttgatatcctctttttctgagcgcctttatggcaatgcctgacatgatggctcccgccagtccgcccgccaaaatcacgacatccgcaaccgctaatgacatgatgcgctgaaacaggctttgaaaggattcccccggcgcctgcacgtaactgatcatctttttattgctgataatgaaaaggcatacaatcggatagacaacagccataatccacgacattctaagcagcatgttcaacagaaagcctatgccgaaaaacagtacaaaaaatagtacgattgagatcaggacaaccggcaaactaatcacaaacatccaccccctacagcactttcagtgtacctcgggggcggtaaaaaagtcaacgtctggaaaaatcagcgtctctctttgccgcttccctggcaggagggacatgtttcggagccgccaagaagcaattgaaaataccctttacctgagcagaacggacacgcagccgtgctttttgctgtcgttttcatgcggatcacccttttttcttaattttctgataatatatcatatttacttgtcaagcaacaagtcagaatatgtaacataacaactcatgtaagcggaaacattcatttttttcttttacatgctttttatagcgctcttttttaaaagaagagaaaacccgcggctgcgggttttcagaagaatttaaacttcccttttttcagcgtcaggcccagcccgccgatcataaagagcgagcggttatcaatgacctttttcataaaggacgccggcgttcctttgagcttcctgccgtatacgactccgacggcgttatgctcaccgagggaggcgaccgttcctttaatgtcaggcttgaactcttcaagctggcctcctttaatcaaaccgcccagatttttggcgaccgtttctccttgctgcatcgcgatctgagcagtcggcgggtacggccgttccgtctcttcattgataaagagcgagctgtcgccgagaataaaaacgtcatcatgtcccggcgcccgaagatcagggttgactttgacacggccgcgcatattttcaaaacccgcttcctccacgatcggatgtccgcgcacacccgcggcccagacaacggtctgcgatttgatttcttccggctcttcatctttcttgccgactgtgacaccgtctgcgcggcattcttgaaccgcggtgccgattttaaattcaacgcctttgctctcaaggtattgaacggcgtaatcgacaagctccggatcaaatcccggcaaaaccgtcggggcggcctcgacacagacgatccggacgagactttcatctatatcataatatctgcataactccggcttgcggttcgcaagttcaccgagaaattcaattcccgtaaagcccgctccgccgacaacgatggttaagcggtcagggcgtttttcggcctccgtattgtatgtcgcaaattggagctcaatatggtctttcagctggcgcgacgtattaatattcgcgatcggaaaagcgaattcttttaaacctttaatcccgaatgtttcagggacggcgccaagcccgatgacgagataatcataagggatgtccccttgtgaaagcgtcacctttttattttgcacatctatcgcttttacggtatcctgcacaaatttaacccgtgattcattgattacatcttttatttgatatctgcagcggtcatgatgcagcgttcctgcgctcgcttcatgcatccatgtcgtttcataatgataattgtgtttattgaccaaagtaatgtcggcgtcatttgccccgatatgcttcggaagccttgttactgtcattaatccaccataacctgcacctaaaaccacgattttgggtttattcaatgccatcacatccaccttcttttttttgctgttagacgcataatcaaatcaacatttgtattagcttcagcttattggcgggattttatgaaatgaaatataaaattttttagaaaaccgcacatgtctgcatatcaccatactatccggaagaatcggaaaacattcaggaaaaaacagattggaatttgtccccatcttagcggcggccgcaatttttttcaagaatgaagcggccgggcggttttcggcctcgtcatcctttcaaattgtatgttataattaataacaattttcaattaggaggcaatttggtatgcaagaggattcaaaggtttatgatattacggtcatcggcggcggcccggtcggcctgtttaccgctttttacgggggaatgagacaggcgagcgtcaaaatcatcgagagcctgcctcagcttggcggccagctcagcgcgctgtaccctgaaaaatatatttatgatgtagccggattcccgaaaatccgcgcccaggaacttgtgaacaacttaaaagagcaaatggcaaagttcgatcagaccatctgcttagagcaggccgttgaatctgttgaaaaacaggcggacggtgtgtttaagcttgtcacgaattcagaaacgcattattcaaaaacggtcattatcaccgcgggaaacggcgcatttaagccgagaaagcttgagctggaatcagcggaacaatatgaaggcaaaaacctgcactacttcattgacgacctcaatcaattcgcaggcagacgcgttgccgttctgggcggcggcgattccgctgttgactgggcgctcatgcttgagccgattgccaaagaagtcagcatcatccaccgccgtgataaattccgcgcgcatgagcacagtgtcgaaaacctgcataattctaaagtcaacgtgctgacaccgtttgttcccgctgaacttgtcggtgaagaccggatcgaacagctcgttctcgaagaagtgaaaggcgaccgtaaagaaatcattgaaattgatgacctgatcgtaaactacggctttgtttcttctctcggcccgattaaaaactggggccttgacatcgagaaaaattccatcgtcgtcaaaagcacgatggaaacgaatattgaaggcttctttgccgccggagatatctgcacatatgaaggcaaagtcaagctgatcgccagcggtttcggcgaagctccgacagccgtgaacaacgcgaaggcttacatggacccgaaagcgcgcgtccagccactgcattctacaagcatgtttgaaaaataatataaaaaagagtctgtgtcataccggcacagactcttttttatttaaacatccaaatataattcatgacggttccgacaacgagcgcaatgacaagcgccgacacgacccaaatcgtgcctaaaataatccggtcctgaattttctgggctttcggactgtgcccgggctgtttttgttccataccggcccctcccttcttctgcaaatctatctatcgtaacaaatgtcttacaacaaccaatactactatgataaccaaactgcaaatggatgacaagctgaccgcatatgaggcagcatgaaatcatttgacattcctgacaaaacaaagtacattataaaaagacgaacattttaattttatttaattatattattcgcttttaggggtgttatatatggaaaatgtatttgattacgaagatattcagctgattcctgaaaaatgcattgttgaaagccgatctgaatgtgatacatcagttacgttgggcggacacacgtttaaacttccggtcgtaccggccaacatgcagacgattatagatgaaaacatcgcggcctggctcgcggaaaacgggtatttttatatcatgcaccgcttcgagccggaaaaacgtctggcttttgtccgggatatgaaagcgcgcggactgatttcttccatcagtgtcggcgtgaaggaaaatgactatgaattcatccgggagctgaaagaacaggagctggtgccggattatattaccattgatatcgcgcacggccattccaatgccgtgatcagcatgattgaatttattaaagaacatgtcccggaaagctttgtcattgcagggaacgtcgggacgcctgaagccgtaagagagctggaacgcgcgggcgctgacgcgacaaaagtgggaatcggccccgggaaagtctgcatcacaaaaattaaaaccggcttcggaaccggcgggtggcaattagccgcgcttcgctggtgcgcaaaagcggcgagcaaaccgatcattgctgacggcggcatccgcacgcacggcgatatcgcgaaatccatccgattcggcgcgtctatggtcatgatcggatcattattcgccggccacgaagaatcaccgggacaaacgatcgaaatcgacggaaagctgtacaaagaatatttcggctccgcttctgaatttcaaaaaggcgaaaagaaaaacgtcgagggcaaaaaaatgcatgtcgaacataaagggtctttgcgggacacgctggttgaaatggagcaggatctgcaatcttccatctcttacgccggcggcaatacactcgaagccatccgtaatgtcgactatgtcatcgtaaaaaactctattttcaacggcgacagattttaacacgcagcagagccgctcgaagataaaaaaaaatgacactcatattgaatgtcatttttttattaaataccgaaataaagagcggcactggctaacagattaatcacaaaaataaacaaaaagatgtaacgaatgaatttattttgcaccggagcaaatataaagagatatagtcctgccaccccaaaagtaagaacaggaaacagccactcaaaggataaagaaatgatataaccgataatcataacaatcggcacaccgattaatgataatttacttctcatatgatttctgccccttttacttaaaaattggtgtgatgtaagcttcaataacggcagcggcgatcagcagacaaataataagcagcaccaatattccaatatgcctgaacattgaagccattatctttttttccttagaaaaacacagcctgatgaccaattcaacgcccttaaaaccaatggcgccacttaataataacgcaggaacttcaaatataccatgaggaattagcagtaaaaaaatctgataaaaaggaaccccgctatgcagattttctataatagagccgcttaaaataaacccgttggtgaataaataaaagattgaggtcaacccaaaggtaaaaaaacccgcggctaaaaacagacaagcgattgcattgtttttcagcagttcaaccgcgcctgacgagccgttgtaagacgctgatgaaacaaagtgatcggaaaaaaacgcagcgatcacaccgcctgaaaaaaacagcactgacgcggttaacggaatggcggacgttctgattgccggcaacatgcggttcatcatgtatagatacgctcagccaattcttcaatctcttctaatgaatgctcggatgactgatactccgccgcaaaaacgccttcatgtataataccgatcgtatcgcacagcgaatgcgccagctccagcaggtgagtcgataacaggactgtatttccctgcttgacgtactcctttaataacgtccgtatcgttttaccgctgattaaatcaatgcccgtcagcggctcgtcaagaattaatatctttggctgatgaatgagcgctgccgcaattgataatttttgtttcattccatgtgaataagttttaatcagctgatttccgtcttgagaaagcttcagcgtctccaacatattctttatataatcatttgtccgctgagacggaacttgaaacatctccgctgtaaagcgcaagtattcgactcccgttaaataatcatacaaaaaggcatggtcgggcacaaaaccgatatcagccgatatttgccccccctcttctgaatccagttccttgccgtcaatcatgacgcggcctgaagtcggtttaagcaggcccgaaatgattttcaaagtcgttgttttcccgactccattagtccccagcaaagcatagattgagccttttttcacctcaaacgaaatatctttcaatacctgtttttcactatagtttttttgtatattcactaatttaatcattgttcgcaaacctttccgccatattgattctgcgaagaaacagaaacatgactccatagtttaatagtgtgaacaggacaaaaatacctgatgcagaatgaataagcatcgtttcaagttccggctttttatagataaaatacgacgtgatcgcagcgatttgaagcgacacaatgaaaatgaaagaactgtataagttgttatacgtctttgctttccccgcttctccaatttcgtacagatgctcccagtttttcttaggatacagggcggtgcttgaaatctggacaagactgtataaaaaacccgaacataaaaacacaataaacaggtaaatcgtcagcgccgcggaagacggaaaaaacaccgtaatcaaaatggtaatgatgaacgaatagataagagcggcgagattataaatacatactttcggaaacaccagctgccacgcatgtttgatattccggtgaaacagatgctgattttttatttccccgtcaactgataatactgttttgagcgcatctccgacgagctgatacgaaaagttcgcaatgataaccgccgcagacacgatggcggctgccgaatacccgataaagtgatgcgatagaagcggaatacaaaaacctaaaaacagcatgaacaaatacagcatactgccgaagttcctgataaaaaacccgtcaattctcgataaaaacagcagatccttttgaaaaacggcatgaaatattttgttatttctatataatttcagctttggcgcaaaatcagcgtttgtcaaaaacatataaggaataaggtccattttcttcagcgtggccgaccacagtttaaacatccccgccgttaaaaggacggcggccgcaaacaccgcagcgaaaacgagcacggaatgtgagcggaatgctaaccatacatacggcgtattcatgaggatgttccggaaagccggtgactccgtaaagcttgaaatatcctttgcggtatactccccaaacacgagaagataaacggcatacccgactgcaagcggaaccagcaggctgacgctgaataaaatgcctttcaggattttcaagtaaaacaatttgctccatatatttgtaagaagataaacaacataagaaaacagcatagataaaaataaattgagaagaaaataaacgaagcccaagaaaaatacgatgatcgccgcagacccggtcatgcctgcgcttgataaaaacaaaaagaccggaaaaacaaaaagataccatacgaaaatggtttttttgatcgcctggccggcaaaaacagaaaacagctgtaaaaaacgcaccttttttaattgatgaatgaccttgcgcgtatccagcagaaaggcattgtgatgttctttaaagaagccggcagcccaaaaaagctgctcaagtgaaacggcgattaaaacaaattgcccccatgcgctgaggggcagctgaatcagttttgtcccgaatacaacaccgcatcccaggaaaacgagatataaacataacagagaaataataatggcagacagcagtttgctgttgagttgaggaatgccccaatcttcctttctttttcgaaacgatgacagggtattatatttgataagagccgcaatttgtttgactatcatactttcaatccttacatatgtatttgggagagaggctctttttgcagcttgtacaaaaagagcaattatttattggtcgattttaccaagcagctgcgtattttttgccgtatttcttaatcattgtttttgctgttgcaacgattgcataagaaatcgcgcctgcgcctgtaacgataccgatgagagaaatgatagaagcaattgttgatgccgcatcaataatatcaattgcttttttagctgctgctgtagagatgcccagagtcgaagctaattcagcattggctgagaatgcatgagccgccgccacgtttaattcagttcccgttaataatagtgcataaaccaatgttgctgcagcaagagccgcgccaaacaaaatgaaagactttttattagattttactaagttcatcataacatctccctactctgtttttttaatttataataaaattcagcttaattgactctctcccgagctaaattttatccgccataaaataattaaagaaaatagtaaagagttttaataaaacaaaacatccagtcaaaatgattctcttgcctttactgagatcggtcagttttcctgcggcagcataaagagccgcaattgatatgagcagaaatggatccagcagctgcagactcaagctggtgccgccggcagaatatataagcgaggaatcagccgttaagtagttaacaactgaaagaatcaacattttaaatgccgaaattaaagaagtcagtgtatatagaagcaaatatatttttttcggtttttttgtaccgagaataaaagcggcaacgaataacagaaatccgcctatcagaatttccacaaaagttgtaaagatcataaacccttgcagaaacatgacaatcgtacgaacacttttctccccgatatcgtaggtactttctccgacggaagaataatacgactgcagaactttatcggaaatactgaattggaagagtaatgaacagatcaaaatgatgaaaaaagaacttaaaaatatttttttattgctcaattgacctatcatattatcatccttttcttacaaaataaattaactattctatacttttacaatttagtttattcctatcaaaaaatcaatatcctttcgaaaaatatgactttagaacgtgttgactaagagcacatctttcagattttttgattctatataccctttatttttttccgaatttgcaaatagtatgatttgaaccgttgatttgaggatttttgtgaaggccgtcactcctaaacctattgaaaatctgcccatttccttttgtgacatatgtctgaattcatcacattttttttattgacttaaaacatggtttaagtcgtatcatcacccagtgacaaggaaaaaatactgttggaggtctttcgaagacatgttgttcaattcgtgaagcagcagcaaagtgtaatatgacagaatcaacgttacgttattatgaaaaaaagggactgctgccgctgattgaacgtgatgaagccagacggcggttattttcagaagatcaaatgccgctccttgaaatcgtgatttgtttaaaaaatacccgcatgaccatcaaaggctttaagcaatatattgattgggtaattgaaggagagagtcctattaaactccggcttgacatgatgaggagacacaagcggtcagtactggatgaaatgtcgtcaatgacaaaggcttatatcaaaagctctgttcaagagacgtaagtttgttgaagtaaaaacaatcggaaaagaggagttaatatgaaactgacgggaaatacaatactgatcacaggcggaaatgccggaataggattggctttcgcagaacggtttttaaaagcgggaaataaagtcatcgtgaccggacggcgtgagcacgctcttcaaaaagcaaaggaaacattcccggatcttattacctatgtcagtgatttgagctttccatctgaacgtgtatcactgtttgattgggtgaaagaaaattatccggaagtgaatgtgttagtaaacaacgcggggattcaacatcgttttcatgtgctgaaagcggatgcgaaggacaattgggactattttaataaagaaatcacaacgaacattgaagctcccttccacctgtctatgctgttcgctccgttttttgccggaaaagaagatgcggctgtcattaacgtctcttcgggattggcttttacaccgcttgccattgcaccgatctattcagcaacgaaagcggcgcttcattcatttacaatgagtctgagacatcagctttctgattcatctgtagaagtgattgaagttgcgcctccggcggtgaatacagatttaggcggagcagggctgcatactcaaggagaaccgctggatgaattcgctgatgggatttttaaaggactgaaagagggcaaactagaaatcggatacggttcttcagcggaacggctgcgcatgtcccgggataaagccgatgaacatacggcaaatatgtacaatgcgatgaaacatacaattgaataacctctttgaaaaagcaaaacccgcttctgttgagcgggttttgcttttattaaacagataaacgccttttttaacaatggtgcaagcgccatcgaaaagaaagacgtcctattttttcatcctgagaatggcgggctgacccttagcactcttccggcgtgccggcgtttttggccgtgcggaaagaagatccgcagccgcaggaagcgatggcattcgggttgtcaatggtgaaaccgccgcccatcatggactgtttgaagtcaatgatcgtgccggtcataatatcaaggctttcgctgtcaaccaaaacggtgattccgtgctgttcaaacatgctgtctttttcgcctttttcgtgctcaaatcccattccgtaagacaggccgctgcagccgccgccttttacgcccacacggagaaacgcgttttcttcttcatgctctttcatcatatcttttatatgcaaagccgctgcttcagtaatagttactggaacactcataggtagacctccttttttaaaaacggatgctgatatctattataaaccttgaggagcgtatttctcaaacgagctgtttacaaataatagacgccgctgcatacggtttcggcgggtcccgtcatcagcacgtgcccgttgtcctgccaattaatcacaagatcgccccccgctaaatgaacggtgatatcccggtttcgttcggaaacaccgttcaatacggatgcaacagccgccgcacaggcgcccgttccgcaagcctgtgtaatgccggagccgcgttcccatacgcggaaatgaagttcatcggcgctgacggtttccacaaattcgacattgacgccttccggaaatctcgggtctttttcaatgacgggaccgagcgttgtaagaggcgcttgattaatatccgcaaccggaaaaacaatatgggggtttcccattgatacggctgttccggaaagctccgtttctccaaaaacaaaggtttcatcgatcgtccgttcatcttcattgccgtgcatcggcagctcttttttggtgaggcgcggttcgcccatatcgacggcgacttcacgcacaatcccgttttcttccgtaatatctgctttcacaaggcctgaaagcgtctcaatgaaaaaggacgtttcttctgtcagcttatgttcgtatgcatactttgccacacagcgaaggccgttgccgcaatttttcccttctgagccgtcattattaaaaatccgcattttgaccggcgctttttctgacggacagatgaggatcattccgtcagagccgatgcccgtgtgaatgctggacactttaacggcaatctcagccagccgttcttccggcagctgttcttcaaattgatttacatatatataactgtttccaagaccgtgcatcttggtaaaacggaatgaattcatatcggcctccaactttttttcttttacttagtataaaagctcttcccctcggacacaatacaaatatcccccgtttttcatacataaaagctccctgcatatgcagggagcttttatcgtttactaaataaacatgccggcaatcgccgcgctgagaaggtttgcgagtgttcccgcaataaccgctcttaatccgaggcgcgcaatgtccgaacggcggcttggggccaaaccgcccagtgtgccgagcataatcgcaatcgaagagaagttggcaaatccgcacagcgcaaagctgataatcgtagacgtttttttagaaaagtccgcaatatgcggaccgaagtttgaataagcgacaaactcattcagcacaagtttctgtccgatatagcttcccgctccgagcgcctcatgccaaggaacgccgattacaaatgcgatcggtgaaaacacgtaaccgagaatggattctaatgtaatatgtttgaaaccgaaccagccgccgattccgccgagaattccgttcactacggcgatgagcgcgacaaacgcaagaagcatggcgccgacattcagagcaatctgaaggcccgtggacgcgccttttgccgctgcatcaatcacattagcggcgccttcgccttcttcgtccatattaaaatcgccttttatcgtctgcgttttttctgtttcaggtattaacatttttccgaacacgagaccggcgggagccgccataaagctggccgccagcagatattcaatcggaatgcctaacagggcgtaaccgaaaagcgtagaacccgctacagccgaaaggccgctcgtcataatcgtaaacagctcggaacgggtcaatcccgcaatcagcggtttaatggcaagcggtgattcagactgtccgacaaaaatattcgcagccgccgcaagcgattccgttctgcttgtcccaagaagttttgacagtccgcctccgatgacgcgaaagatgagctgcatgattttcaagtgatacaaaacggcaatcagcgctgagaaaaagataatgaccggcagaacgctcagcgcgaaagccgggctgctgcccacttttaacagcgggccaaaaataaagctgatgccttcgttcgcataatcaatgagaagctgcacacggcttgagaaccataaaaatacggcccggccggcgtcccactttaatacgatgaatccgaaggccatttgtaaacataaaccgacaatgacggttcgcaggttaattttgcttttcttctctgataacaaaaaagcaatggctaatatagcaactgccccgagcagcccccaaacgatattcaatgaatccacctctaaaattttatttaaaaaaagtctttattaagataacaatatttatttttgctgtctacaaattttttattttgccaaaacccgggcgcaataaaaaagagaccccgttcggagcctctgattaaaacatcggattttcttctatgaatgtatatatgttgtcaaccaactcagcaggcgtgccccccgtgaccacttcgccgttaaccagggcgaacagggactccatgcattttccgcagtagcttaaacagccgtactcaagcacgtccaagttcggatccttctctaagatctcaagtgcttcctgggaaccgcgcgctaaattgctgacacagaattcaatcatcggattcatgcggtttcacctcacatatgtaccttatcctaacggaatttcctctattcgtcaaagatccggtttcacgctcaatgttatcgtaacatattaattcgggttaaaggttttactattgcgtgttttccggtcaatttgtaggttattttaaaactattattgtggttttagatcaaattcgatataattctagatgttattttacatagttcgttattttgtaacaatattgactaccatatttttcgggcaaaaggggaatcattatgaaaaaattggtcttgatcggcgggggttacggaaacatgcgggtgctgcaccgcttactgccgaaccagcttccgtcagatgtatccatcacgctgattgacagaaacccgtatcactgcttaaaaacagaatattatgcgctcgcagccggcacgatttctgatcatcatatcagggtgtcttttcctgagcatccgaatctggatgttcagtacggtgaggtggcttccatcgacacgaaaaacaaacaggttctgtttcatgaccgcgaaccgatttcttacgatgacgcggtgatcggactgggctgtgaggataagtatcataacgtgcccggcgcgccggaacatacttacagcattcagaccattgatcagtcacgcgaagcctatcaaaagctgaacaacctcggcgccaatgcatctgtcgctatcgtcggagcgggattaagcggcgtggagcttgccagtgaattaagagagagccgtgacgatctgaagattatgttatttgaccggggcgacctgattttatcaagctttccgaaaagactcagcaagtacgttcagaaatggtttgaagaacacggcgtcaccattatcaacaatgcgaatattacaaaagtggaagacggcatcgtttataatcatgatgaaggaataccggccgatgccatcgtgtggacggcgggaattcagccgaataaagccgtcagagaactggatgctgaaaaagacccgcaaggccgcatcgttttaacaccgcatcacaaccttccgggcgatgagcatgtttacgtcgtcggtgattgcgcgagcctgccgcatgcgccgagcgcccagctggctgaagcgcaggcggaacaaattgtgcagatcctcctgaaacgctggaacaatgaagagctgccggaaacaatgccgcaatttaagctgaaaggcgtcctcggttcactcggaaaaaaagcgggcttcggtcttgtcaacgaccgtccgctcatcgggcgtgtgccccgtttattaaaatcaggccttttatggatgtacaagcatcataacggctgataagaaaaaagccgctgattgcgatcagcggccatttttaagagcccgcaacatagccgcgcttttccatttcttcatatatatcttttaaatgcggattcccttcccccacaatgacatcctccaccagcacgagcggatagaaaaattcatcgttcttgatgcgctccgcaagctcttctgtctccttttgctgaggcggtgcctcaatatcaatataccgcatgttaaaaggctgctccgggtatttccgtttcagcgccgcctccagccattcaaacgtatctttggcgctcggcatattcacgcagcttgcgcaaagcgtttcagcgccgtaaacactgagcgtaaccggctttgtcatgtatatcatcccctttacaccagtatacaaaggacggggcagcttttgtataaaaaacggtttttatgttcaagtttaaatatgctataatggagaaagcagctttgcaaaccaaacattagatttttaccgttactgtgaatataatggttttatgtatatgaaaggagcgaatctcatgactgaggttgaaatgaaagagcaagtacaggaagtattggataaattacgtccgtttctgcttcgtgacggcggtgactgtgagcttgttgatgtagacgaaggcattgtaaagcttcgcctccttggcgcatgcggcagctgcccaagttcaacgattacgctgaaagccggaattgaacgcgcccttcttgaagaagtaccgggtgtcgttgaagtagaacaagtattttaattataaaaccaggctgcatgacagcctggtttttttatttttacaaatagtcatcaaaccatgaacaaatataacggatgcgtttcatccgctgttcgggatggccgcttctcgacagctcatgcgtagctttcggaaatcggatgaacgacgtcgttttgttcagtttcttcaacgcggtaaagagctgctccgcctgctctatcggacagcggtcatctcgctcaccgtgcaggatcaaaagcggcgtcgaaacgcgggatgcatattttacaggagaacgatcccaaagcttatccgcttcctcaaacaaatcatgtccgagctgccagtcggtaaaaaagaagccgatatcgctgacaccgtggaagctgaaccaatttgaaatggagcgctgcgtgacggctgctttaaaacggcctgtctgtccgacaatccaattcgtcataaaccctccgtagcttccgcccgtcacaccgagacggccgctgtctaaaaacggatacgcctgaacggcttcatccaccgcctgcatgacatcacggtaatctccgcctccgtaatcacccctgacacgattgacaaaatcctgtccgtagccgtggcttcctctcgggttgacatacacgacagcatatccttgtgcggccagcacttggaattcgtgaaaatacgtatggccgtacatcatgtgaggcccgccgtgtatgtatagaatgaggggatatgtttgatcctcttcaaaaacggcaggctttaaaaaccagccgtttaccgtcagcccgtcctttgtttcatattgcagcttttccggcacggatatgatacgctcctctataaaccgatcattgtaaaatgtcaattgcctctcttccccattttcaagtgaaatgctgtaaagctcggaaggctgtgcgggtttggcaatgacagcgatacagcttttctgatcaggatgaaaagcaaaaccgttcacgtactcttcttctaatcggatcggatatacgaggccgtcaatcgagatataataaataccggtgcttccctgctcgctcccgagaacgtaaaagccctgcccgtcgtttgtccataccggccggggcgtcactcctcctatgattgaatccgcaatcagcgcatcgctcaaatgaacatccagcatgtcggtcaggcaggacagccgctcagttttcacgtcgtacagccacgctttctctaaagtcgcattgcgaaattcattctcatggcccagcatcgcgatataagaaccgtccggtgaaaacacgcaggaaccgaaagaaccgcggtgcggcgtaatctgcttcaggcttccgtccgccagattcatcagatagacatcgctcggctttccggcgtcacccggctcgcataaattggcggtaaacgcaagctgcctgccatccggtgaaaaggccgcgccataatgatcagcttcatgatctgtcagctgctgaatctcccccgtttcaagatgaatcagcacaagctgtgtccggcttccgttcagcaggcccttcccgtcacgtttatatgttaatgattgaatctcaaccggctcatactcgtcatgcttctttttttctttctcatcggcgcgctccgctgatgtcagactgacggacacaagcacggatctgccgtcgggcgcccatatcggatctgatacgccccaaggaatatcggcagcctgttccgcctctccgccggcagcgtcgatgatgtacagctgagggatgccgtcctccctgtcagaaacaaaggcgaggcgccgaccgtcaggcgaccaccgcggacttgtatgtttatcgtccccgaaagtccacgggtttgagatgccggattctgtgtcatataccataatagctgaggaataggaatcccgcttatgattgactgttgtccggacgtaagcggctcttctgccgtcaggggcatattgcgggtctgtcacggatacgagagacgcaatgtcctcctcggttatgagttttttcaaatcgtttctcctccttttcttttttatttcgcttccctaaataaaaatccttctccagaaaaagaaaacgtccttctctgatgggaagaacgcttttttatcattatacacttttcacctgttctaaaggattccgttcaattacgcttccttctgacgggacggtaagcgccgcaatctcacagtgagggaaatgctcagaaagctgttttctcagctcttctccctttcctttttcaatcaggacaagaatcgtcggtcccgctccgctcagcgccgttccgtaagcgcctttcatttcggccgcgtgttccacctttgaaagctcaggaacaagcatggcgcggtacggctgatggaggatgtcttttctcatcattttcccggcgagcgcccagtcatttgacatgatcgcagcaacgagaaggttgctgacggcgcttgctttaacggcgcgtcggtacggcagctctttcgggagcacgtctcttgcgtccctggtcagaacttcgtaaaacggaatcactgccacaacatcgatatccgcttcggcaacacgcacgatatgtgtttcatcttcttcgtgaaggccgattacaagccctcctgcaagggaagcagcggcattatcagggtgcccctcttcaagactggctaagtgcagcttgtcgctttccgacagctgcaggccgcataactcatccgcaagctcaatggcggcgacgatagcggccgcgctgcttccgagaccccgcgcaagggggatgtcactccaaactttgacatgggcgggcggcagctctttctgatagcggtcagccgtccgtttggcgacttggtagatgaggttgtccgttccttgagggatgcccgcgacagtttcggtttccgccgagaactgccattcatcgtttcggaaaaccgaaagcttcaaatatctgctgagcgccattccgatggaatcaaacccaggtcctaagttggcggtgcttcccggaaccgtaatggaaaacagcatctccgcctcattcatacacgcgccgctccatttaagtattccagaatactgtcctcatctgtcggcagcgtgatcggttttatgtcagatacgtccacagccgtattcggatctttcaggccgtttccggtcaagactgcgacaaccttgcttccttttggaatttcaccggatttcacctgttttaaaacaccggcgatggatgcacaggagcccggctcggcaaatacgccttcttcacgggcaatcagctgataagcgtgaaggatttctccatctgtgacttcatcaatttttccggctgattcttccgcagcgagcacggctttgtcccagctggcgggattcccgatccggattgccgtcgcaacggtttctggatttttaatgacttcgccgcggacgatagccgcagaaccttccgcttcaaaaccgcgcatcttcggaagtccggtgccgtttttctcatgatattctttgaaccctttccagtaggccgtgatattcccggcatttcctaccgggatcgccagaatgtccggcgcttcgccgagctgttcgcatacttcaaaggccgctgttttttgcccttcaatccggtaagggtttactgaattcactaatgcaatcggtgatttttcacaaatcgaccggacgatggccagcgcgtcgtcaaagtttccgtcaatcgcgatgatttccgcaccgtacatgacggcctgcgcaagctttccgaaggcgattttcccgtccgggatgatgacgatgcatttcatgccggctctcgccgcgtatgcggcagccgcagcggatgtgttgcctgttgaggcgcacatgatggtatcattgccttcttctttcgctttggcgaccgccatgaccatgccgcggtctttaaaggatcccgtcggattaacgccctctgttttcacatgcagttcaattccgagcttttcagaaagcttcgggaggtgaatcagcggcgtgttgccttcatgcaatgtcagggccggcgtccgatccgtcaccggcagaaattctttatattgatggatgagtcctttccacattagctccaaccgttcccttctacacgatatgtgctttttacttcttgtacaacttctagatcatttaagttttgcagaatgtcactgaaatcttcttccgatgtatgatgcgtgacgatgacgatttccgcgagatcgtcatgtcctttgatcggcagctgcagaattttttcaaagctgacgccgcgctctgagaaggccgatgtgatttttgaaaaagagcccacctggtctttgacatgaattcttaaaaactgctgggcgtagatatcagacggctgcttcagatttctttcaaattgcggggcgacaaagctgtttccgtttacgccgagacgcatgtttttcatgaccgcgaccagatcggaaacgactgatgtcgcagtcggcatgcttccggctccggggccgtaaaacatcgtttcgcctacggcttctccgtacacgtaaacggcattaaactcgttatgcacggcagagagcggatgatgatccgggagcagtgtcggctgaacgctgacttcgattttattgtcatcacgctgggcgatgccgatcagcttcatcgtatagccgagccgtttgctgaagctgatgtcttcatccgtaatccgggaaattccttttaccttgacatcgtccagatcgacgttcatagagaagccgagacgggctaaaatcgccatcttgcgtgcggcatcgagtccttctacatcggcggtcgggtccgcttccgcgaatccgagatcctgcgcttccttcagcacttcttcatacgggcttttttctttaatcattttcgttaagatgaagttcgtcgttccgttgacgattcccatcatttttgtgatccggtcagaggaaaggccttcttcgagcgtgcgtaaaatcgggattccgccggcgacactcgcttcgtaatacaagtcacagccattttcctttgcggcggctaaaagctctgacccgtatacggcgatcagatctttatttgcggtcacaacatgttttttcgctttcaaggcatcaagaagatattgcttcgtctgttcaacaccgccgatgacttcaataatcacgtcgacctcagggtcatcgatcacatcatagacttctgtcgtcagcacttctttcggcaggtctgcgtctcgttttttatcaatatctttaaccagcacttttttaatcgtcaccggacagccgacctggtgcataagcttatcctgatgatcttgtataattttgacgactccgcttcccacggttcccagtcctaacagtccaatacgaatcgcttccaaagagaaactccacctttcttccttttgtccactagaaaaggacaattgttaacccttcacagacatttaagttacaaatattatataagcccgtatttgttttgacaagcggctgaatattgtttctacggccatgaaaacgcttaacacattgatatgacaagattccttattttctaaatatttttacgttatattttcttacgaactgattccttttccgagccacgccacaggcgggacaaaaacctgcgccgacctgacattcatcatgtcgtgacatgtctgtaaaaactgttcatagcgggtgcagtcggcaagaatgtagtcaagctgctcttcgtaaaactgtttttcagaatcatgagaaatgtaatagctctccaccgtctcaaagaaatgaagcggaaacagcaggcggctgtaaaacaggcgcttggaaaaggaggataacggcgtaacttgctcatattcctgcaaaaacaaaaacccttcgttaagcaagtcgtcacgatgatacaaatatgtgctgcgcatatattccgcaatatcacgggcggcatggtcgaatacccaatctcccggaatgcggatcaatgattcctccgaccaggtatcccgttccatccgctgatggcagattgtccccgagtcttctgcgccgggattgtcatccagctccgtatccactaaatattgaatcgcattttccgctaagcctgaataataaggaaatgcttcgatcattttcttttcgaacggttcaagcggagacatatgaattttctgcatccagaatgattccagctgatccacccgttttccccataagtccttccattggccgatcctgcccgcttctttcacttcgtacggaaaaccccgcccttttctgtgaaattcggcaagctcccctccgacagagaacgaccggtttgcgacggggatcggcgcttttaagagcgcatacgttttgccttcgtcctcaaaggtcagttctccttccttcgtaaagataaacactgaaacgtatgggtcactttgttcttgtaaatactgactcatgtagtaaagctccgtcagctctgattgcgaaaacccggaaacgggaataataagaaagaaggaattaggcgtctggaagcattggtatttctgataaacggaaagctgtctgacgtggatgccgtacttttctttaatgatgcttttcatcataatcacctgcctgaaaaattagagctattcacatcgtagtcatacgccggcggaattatgaatacatattgtaatcctttgaatcaagtggagaaacatcgtacacatcggaagggtgttgtataaactagtaaaaaaagattgggtgaagcaaatgtcagaaaaggaacaactgaatcaggtggaagctgtcgccagagcgcgtttaaaagaacggggggttgagacggacgatattgccgagctggtgtatttccttcagaaaaaatatcatcctgatttgacgatggaagtatgcaggctcaatgtggaccgtgtcatcgcaaaacgcgaggtgcaaaacgccattttaacgggaatagaattagatgtgctcgccgaacaaaaaaaactgtctgaaccgcttcagaccattctggcgattgatgaaagcctgtatggggttgacgaggtgctcgccttctctatcgtgaatatatacggctcaatcggctttacgaattacggctacattgacaaagaaaaacccggcattctcgggcggttaaatgataaatctacgggcaaatgccatacgtttcttgatgatatcgtcggcgcaatcgcagcagcggcttcaagccggcttgcccacagcgccagaaatacagaataaggacggccgtcatggccgtcccttttttatagatgttcaatccattctgttaaagagtcaatcgcatatgtcggcttccggtcgtaatctgccatatgctcacgctttgtcactccggtatgaaccagcagcgtatccatgcccgcattgatgccggccataatatccgttgcatagttatcgccgaccatgagtgtttcggaaatatccgttccgagcacacgcatcgcctgttccataataatggattcaggcttgccgataaagacaggctcaacgcccgttgacaccgtcaagacggatgtgagcgaaccgttccctggtaaaagccctctttcagtcggaatggcgacgtcgccgtttgttgaaatgaaccgggcgccgtttctgatcgcaaggcatcccgttgccaacttttcatatgtaatgccgcggtcgattcccacaacgacaaagtccgcgttttcttctccgaagctcagcccgttttcttcaatggcctggcggatgccttcttcgccgatcacatacaccgacgcgtcttttttctgctgggcgatatgctgcgcagtcgccatgctcgtcgtgaagacctgctcttcagttgccggaatgtcaaagctcatcagcttgtccgccacctgcttcggcgtccgggaagaattgttcgtcacgaataaatacggaatgccgcgcgctttaagcgttctcacgaattcacacgcttcttcgattttttccgtcccgttgtacattgtgccgtccaaatctatcaaatatcctttataatccttcatactcaacactcctgtggattttctcactcgttgttatttaaatgcggaaacaggccctaattctgtttccaggtaggttcttacacgggccggaaaggctttcagcacgtccctgtttgacgtgatcagcgtaaacagctcctgatgatcggcttgctgatattcctgaacaagccgctttctggaagaaatcagctgcttgagcttattcgcttcatcctcagctaccaccttttcatccgtcagaatatccatgatgtcgtcataactccccggatcgcgcatgataaagccgtcaatcatatcatttccgacatcgagaatgcattcgatcataagatggctgatccgctcaagcgctcttttttcgatttcgctctgccatgcgggcgtgctgtcaaacagcgccagctgggtctcaaaaaaacggagtgtttgttcgatattatttctgtcaacaaaatacacgtgacagcatccccttctgcatcaattattttctgattcgttttaaaacaaaatacgcgcagccgaaattgcagtattcataaatgtattcgtccaatgtgctgattttcgtttcaaaggttgctttttgattctggtcatcaaagaagcctttgagccgcagctgactgtatccccagtctcccacaatgtaatcatatttatttaatatgtccgaatagcgggctttgaacgcttcttcattaaagccgtttttaaaatcgtgtacgagttcaaactcggcattttgaataagaatcatgtcttcacctcttttatcactctttactatcataattcattgacttctgtccatcaattgcaaaatgagacggttcggacggacggaaaaattttccccttttatatccagtgtagcggttctgacgatccttattcaagaatgactttttccctgcacagacggctccatcacaaaaaacccaaaacctgcggcgttttgggttttttcggcttatcttatgcttgggcctggcgttttttagacgcttcgttcacttgttcatccgcatgataggaagaacggacaagcgggcctgcttcacagtggctgaagcctttttgcatcgcgatttctttcagttcggcaaattcgtccggatgataatatttttggacttttaaatgttttttcgacggctgcaggtattggccgatcgccatgatgtcgacattgttcgcaagcaggtcgtccatcacttcaataatttcttccttcgtttcgccgagaccgatcataatgcttgatttcgtcgggatgtcaggctgcatttctttcgcacggcgcaagaattccaaagaacggtcatatgttgcgcgggcccggactctcggtgtcaggcggcggacggtttcaatgttgtggttcagaatatcaggacgggtatccattaatgttttcaggttgtcgtaatttccgcccatatcggatggcagcacttcaattgtcgtgaacgggctttttctgcggatcgcccggaccgtttccgcaaagacgcctgctccgccgtctttctgatcatcacgcgccacggccgtgatgacggcgtgctttaagttcatcagtgcaaccgaatcagctacgcgttccggttcctgcagatccagctcagtcggcagacccgttttgacagcgcagaagcggcatgctctcgtacagacggaaccgagaatcatgaacgtcgccgtacgtctgacagcccagcattcatggatgttcgggcattttgcttcttcacatacggtatgcagattattttcacgcattaattttttcagacccgtatagttttcattcgtgttcagctttattttgagccattccggctttctcagatgctcgtctttctttgccatttccccatcatctccattatccctttattcatgttcgtgtgcgaaaaatttctatttcacgatggatataaaacttgcagatttctattcaatagtcactttaacataggaaaaatttctcgacaagggaagagaattacttacattttctcggattgttgccgcaaactagttgtattaatcctgaaaggagatcatgttgtgaaagttctgttatctgctcttctccttttatcatttttctgtccggctgcaagcgggaaagaacaatcggctcctgtttacggtgaacggatgcagttataccgcaaagccgaagcagtcacgcagattccttggtatgtgcttgcggcggttgatcaatatgaagaaaatgtccgctcgaaccgaaaggatctgccggaaaaagcgggaatcatcagcatttatattccggatcatttgtggagcgggcctgaaaatccaaatcctaaggacgaggcgcccctcagcattaaagtatttgacgggatcggcctggacggcgacggcgacggaaaggccgaggtcagcaatgatgaggatatcctttatacatttgcacagtatttagcgggattcggaacggatcttgaccatatccgcatcggcctctggaattattaccgccgtgatcagacggtcggcattatcaccgaattcatgacactgtttaaaacgttcggccgccttgatctcggagagcacgcttttccgcttcccgtgaagacggattacagctaccgcagcacatggggcgccgcacggggtttcggcgggcgccggattcacgaaggaacggatctgttcgctcattacggactccccgtcagatcgacctgctacggtattgttgaaatgaagggctggaaccgtttcggcggctggagaatcggcatcagggatatcaataatacgtatcactacttcgctcacctgaacggctttgcaaaaggtgtgcataaaggccagatcgtcaaacccggagaggtgatcggctctgtcggcagttccggatacggaccgccgggtaccgcgggaaaattcccgccgcatcttcactacgggatgtataaagataacggcagatcggaatggtcttttgacccgtatccccatttaagggcatgggagcgaaaagaaatccgcaggaaaaagtaaacacacagccgccaggaaagattgcggctgtgtgtttttatttatctttcttctgtttttcactcggcagctggacagaaggcgtcacacctgacccgccgcttccgttataaaactgcggcacctctccttgaatcgctttaatggagaccggaatattatttgtgacgactgatgtcttactggcaaacggaataatgaccttcactttaatctccacaaaaatactgatatcgatcagggcattgttaatgccgtacggctttatttttgttttcacatcggttaacgcatcaccgatcaggttaaagcgcacggggattttcggccccagatttccgagaacgctgtttcccgtgacctgccctaaagggatgttaatcataatttcatcggccgttttcgcgcctttttccgtttcatgctgcttattgttcgactccgcttccttcaaatgagcctgaagctgctttgtcactttcgccttcatgctgttgaccatttgtgtattaaaatccatcgttgtgacttttccgttttcatccgttttcatatcgaccatatctttcacattgtcgctgtgagacatgtattcttcaatggattccgtaatgacctctgtcgccacccgtttggtttccatttctcctatgttcatcagcaccggtttgattgaggagttgatcatccagaggctgatgaccgtcgatatgataaaaaaagcaaacgacagaagaagcacatatcgaaaaggcaaaggccctctcttgcgaagagcgctccggtatctaggcaagaaaaatccccccttacatatcacaatgtatgcttgtaagaggggacatagtattttatttttgctcttaaaaagtcccgcttaccttcattcgggtgagatggaacggccggcggatatttgacattacgcttgccgcgcgagcttccaggcgagcagatcccttaaaaactccggcataaagtattgtttttcttttgaatcgcggatgtaagggaacagcttgccgagtgtaaacatgtcgagaacggcaaccgagtatatccgctccggatcaacctcttctccgttcactttcacattgaggagatgcgtcacaccgtcttcaaggatgccggcctctgcctccgctccggcatataccatcctgcccatcacttccccgcggaagcctaggcctttaatccgcagccgttccatttgttccgaggcggcctggctgattgtttcccggagttccctgcctgaaagacgaacggcgaccggattgatcggatgagggcagatgcggtgcaagtcaagttttgtgacaggccccttctgtaaaggccccaaaatgacgcctgaattcaccatgctgacttcacagccgcaccagcttttcagcgcttcggctaatagaagcgggagcggcgattcctcaaaccacttcacgccggcttcttcattcagattggcgacttgtacggagagcaggttttccgcttcccgttctttctctttcagaaaagccgccgtatcttcagattccccgtgccaatcagccattttctgtacagatgcctgtttgctgacaatggttcgtgattcactttctatcgtcagctcgacacagccgacatagttcccgtatttctccgcacatgcaagcaatacgccgtttatatcctgtccgtcctcaagaaggtggtgcgtatgtgattcaagaatgacatcgatgtcgggaaatttttccgctgcggcccggtcatcgatcaggcctaaatgagaaagcagaatgatgatgtccgctttacccttgatatcgtcaagtgattcttgaatgcttttttccgcatccgtcaccgtccagccgagtttctgatagacgggataatacggcaccgtgacgcctagtatgccggcggtcaacccgtttttcagcgttttgatcacgtagggctcggcccattccgggcgctgtccgtccgcgtcaaacaggttggacacaatgacgggaaacgcggcatgagtatataaatccgccagctcatcatgaggcagcgtaatcccttcattattcccgacggcagccgcatcaatctcaagacggtttaacaagtcgacattcgctttgccgaaggtcgcttccgttatcatttggaatcggtccatatgatcgccgatgtcgaatacgagtgtttcctccccgtccttttcatgctcacttctcttctgctcaatataatgtacgattttcggccaattttcgaaatggctgtgcaaatcattcgtatgatataaacggagcttctctaacataccatctctcctaccttttagctgaatatcccttgataaatcaattcacagccgatcaaaatcaagacgacccgcatgaaaagcacgatcgttttcgtctgcacccgcttattgacccacgcgcccattttgccgccgaaccacgcgcccggaacgaggcacagcgcatacagccaattgacatggccctctgcgatatgtgacacggaacccgtcacggaggataagaaaatgatgagcattgacgtcgccacagccactttcggcgggaacaaaaataacagcatcatggccggaaccataagagagccgccgccgatgccgaaaagaccgcccaataaaccgacgaaaaaggcaatggcgataccggtaaaaatacggtacgaatatgtataaagctcacccgtttcatcctcatatgtccggatcatgcctttatgcgctttattgaccggttttgctttcgccttcagcattaatgtaatagaaatcaaaatcataaaaagtccgaaccagacggaaaacgtatgcgcattaaaaagtttagacaaatacgcgccgatgatgcttcccgggccggaaccgataaaaaagatcagtccgcttttgtagtcaacggttttatatttcatataggccagagttgacgacaggcccgtaaaaataatcaccaaaagggacgtgccgatggcagtctgcggtgttacgtcatggaaaaacggggtcatcgtgcttaaatagagcatcgccggcacgatgataattcctcccccaagcccgatcaggctgccgaccgttcccgcgataaatcccaatataatcaaaataagataagacatgtgtcttgaaacctcttttctagctgaataggtcgagctgcttcggagcaagcccggtatatgagatatttaacatttcaagcatctcaagcccgttatcggccgcgtctccgcctgagttattgttgaagagcacatacagattgcgcgactgctttttcagctcctgaagattgtttttccaatctttgagctcctgtttgttatagcggtataaatatctgacctcacgccagttttgtccgccgtcaggtttgatccagccctgcttgttccgtccgtgaaaacggacaagcgttttttcttcatccgttgctttcaggacggtcggaatgctgccctcgccgatttgcggctcgtcacatatgctgtgaatccagccttcctccttcataaaggaaagcgtctgttcgtaaaatggcggggaaaaccaagaccggttgcggaattcaagcgcgcacgggatatcgcccatctgctgcctgcaccatcttaaatatgcgacgttttctttcttgcagtcaaaccacggcgggaattggaacagcaccatggcaagctttccatgctctatatacggcgataatgacagcttaaacgcctcaaacatttcttccttcgattcaaagggaatatcgccgcgctgatgacccgtcattccttgatatgccttaatgacaaattgaaaagattccggcgtctctttgacccatctttcgttattgcgggcgggctgtatcgcgtaaaagctcgcgtccagctcaacgatgggaaaatgggaggaatacgcctgcagtttttgcgggcccgctgttttaagcggatagatgctgtcatgatccccccaccccgtcagtccgatataaatcacaatccttcacctctcattctagtttatcacaggtgtttttctctttccgtttccatgttttttctgaatgcacttttcaggtaacggtactgatgttcattggtgtccgaaaatgcctcatctctggaagaaagaatgtgctgatagacgatcggctctgaaaactgactgctcgtgaaatcatatatctccccgtctattcgattataaaaatgccagcttgtgccggtttttgttttgagaatgtcaccgccgtaaacatcttggatgactaaagccgtcacgccgcactggcctgtggccgggcaatcttccgtccattttgtactggtcttgcgcgaccaggatgccgttaatatgttcaagatttgatcatacaatgtgttttactcctttttataaaaagataccacgagacccgctctccaaacgacaaaaaaagccgattctcatcagagaatcggctcttttatttcagaaggcttcagaaatgttccgaaagcccccctctgcttacgaccgccatcctggtacacacagcgccccttgctgtaggtcgcagcaattcggtatggaaaggtgcggccttcatacaggctttgcttatgtttggaaaacatcgtttcttttgtgacggtaaaaggttccggccggacaatggcaaaatcagcgtcaaatccttcttcaagccggcctttattcgttaaaccgaaacgtttggcaggtgcttctgccgtccatcgggccacatgttcaaacggaatcccatgatcgatcgctaattgaatcatgccgagaagcgtaaattggcctccgctgatcccgccccacgacaggaacatattatcctcgcgtttcaaagccggatgacagggagaatgatccgaagacaccatatcaatcaggccctcagccaaaaccccgatcaattcctctttatcagcctctgagcggagcggcggagcgcatttggcagccgccccttttttgaggaagtcttcaaagctgaataataagtagtgcggacatgtttcaacggtgacatccaatccgtcttttttcgcctgctgaatggagagcacggcccgtttcgtgctgatatgtacaaaatgaagcgcgcatcccgtcgctcttgcatattcaatcgcccgctgcacagcctcgcattcggcttcttccggacgggaggaagcgtaagcgcgggcatcaattttcccttggagcgcgtactcggcttcaaggaatcgggtgagggcgtcgctttctgcatgcagggccaaaatcctgccgcacgccgcgatttccttcattccctttaaaagagtccgttcatcggctgattgaaattcatccgttcccgatttagacagaaacgctttaaacccgattgcccccgcttctgccatcggccggatatgttcggtatacccgggcatcaaaccgccccaaagcgcaaaatcaaccgctgacttccgttcggcgatttccgcctttgccagcaggttttcagcagttaccgtcgaaggaatgcagttaagcggcatgtcaaaataagccgtacagccgccggcagcaagcatgtttgagccggtttcaatgccttcccattcttcgcgtccgggttcattgaaatgcacgtgacaatcgaccgcgcccggaaacacatacatgccgtctgcctgcaccacttgttccgcgttttcgtcaatgccgggctcgattaatgcaattttcccgtccttgacggcgatatcggcccgctctgtcccgccttttcgcacagctttcgcaccctttacaattacgtcataggtcattttatcttcctccctgtaaggatgacgattttctgtcagtttttatcacaacatgcgtctatgattgccagtttactgctactatgatcgtaatacatcagcaaaaccgctataatttttgatgacttttattcatattaaccaatggttgtctttagaacctgaaaggagattgactgatgaacatttatgatgtgatgaagattcccgcttatgagcgggccgcattaatcgcaggcagatccggcggctggagggaggtgcagcacgtcaacatgatggatgcgccggacatcgctgattttttacataaaaacgaattgctcgtcacgacggcttaccacttgaaggaccgcccgcagctgttgaaagatttaatccgcctcatggcaaaacggggatgcgcgggactggggatcaaaacgaagcgctatcttaatgtcattccgaaagatgccgcggagcttgccgaccggtatgaatttccgattattgagctgccggaagacatcaggctgggagatatcgtcaatgctacattgagccatattcttgatatgcgttcaaatgagctgcagcaggccatttacgcccataaaaaatttacaaaccacatcatgagcggcaaagggctgcaatccctgcttaagaagctctcagacatcctccggcttcccgtgctgcttttggatcagcatacaaaactcttatcatcgtcccacagcatacccattgacacgtctttattgaaaaacatctgttattccctttccggtccttatttcacctgcttttccatgctctccgacagaaaggtgtattctgtcctgccgattctgaatgttgaaaaaaactgcggttatctggtgattccggagctggtgcagaccgctgataaaggcatgattttgacaattgaacaggcggccaacgtcatttcctttgaactgctgaaagaaaatgccgtcaaacaattcggcagacgggcgcgcaatgaatttttcagcaatttcatcgaccgctcgtttaccggccatgaagaaatcaaaagccgtgccaaagaattccggctccgctgggatcagaaatacatgtgcatttgcggaaaactcgaccgaaatgagaaaacgatcagctttaccgaaaatcagctcgtttccgatcatgtatttgatctgcttgaaggggagctgtcatcctttccgtttccccctcatctctttattaaaggaaatgtcggtattcttttaattgaagcgacagacagctggaatgaaatgcacgcgtctgtcatcagctttttggagcagtttcagaaacaggtccggacgcagtttaaacggactgtctccttcggcatctcaaacatatgccaaaagctgatcgatgtccctgacgcttttactgaagcttcagacgccatttcatccgggcatttgtccagaagcgcggagtttattcaaatctatcatgccaaagacgtgccggagctgctcggcctgcttccggcggaagatgtgaaaaagttttacgaagccaccctccaaagcctggccgaccggcaaaaggaggaccagagcctgcttcatacactgtctgtttacctggaaacccactgccagatttcagaaacggctaagcgcctgtacgtccatcgaaatacggtgatctatcgtttagaaaaatgcgaggaactgctcggcaaaagcttaaaagatccggagacgacgatgcgcctgcggctcgcgctgagaatgcagcggctgatcggttaaaatttagccatagaccaggatgcgggtgttctcccgcatcttatttaagggagatcattcagctaaatcctcaaaaaatgctgccattgatatcatcaggctttttcgatattcgggatgcaaccgataatctcaccctttttgatttcatcctaaactgcctcggaacctttgtcacaagcacccatgacccttttttgatggtttcgccatttatttgaaaatcagcggggagcgacacaagactcaaccacttccccaacgccgccctgaaagtcatgctgcttttccttttctgatttcataaaaaaaccgcttttgattagcagccttatctacgtaagaaacatgtatgatgtttgcatttatcaattctcttggcatgtgttcactcatttcaaagaatatttaacaatatctccatcgttatatttccgttaagtgttattgttatcctataaataccaaaaggaggttttacgttgaaactagctaaaaatgctttgttatcacttgcaattgtttcattcgttttcgcgcctttttttaactcttcagcatcagccgccggtccctctactaaagtgaataagaatttgtttcaatctcagtctgaaacccgcgtcaatttaaaagtaggagagataaggaattattctacttctggtaatcgcatttcctttaatcctacgggttataaccctcctgctgtgacatggagagctttaggtactgactacaaaaccattcaggtatttgcagtcgctaaaggagaagcctggattgaattctatgatgattcctccacttggaaaacccgataccattttgtagttcagtaataatccgaagagatagattctatctcttctttttaattaaacgattgcgacgttttgaattttttatttttcctcaactgacagccccaaaatctcgttatctactacaggagacagaacgcagtgacaatgaacccgctcagcggcggaaagctttgtgtctcgcggatacatacaggtttcgctgcttcctggtatcttgaattcttcgtcaacaccaacagtcgaacacatcaagaccaaaaaccgcttctgacaggccgcgcaagaggattttataaaaatttccaaaaaggaggggcgcttcccctccgtgaaccgtaataaagcttcgtgtgttggctaatggataatggtctcactgtcatcctggaaagatcacttacttctataagtctttctttttaacagaaaccgcagatatagcagcagaaataactatccgctccgcttcttatgcactctctgtaacatggggaattataaaaaggagggcgcgcggaaacatagggggagccccctgaatgagtcaattgatgggcccatggataataattaaattcttgccgctgatacaaatggaatgacgggtaataatacaacattttcaactccttttccgtacaccatattgtacttaccgacaccctttttagatgattgtctcttgcataattgtgtgttggcctaattgcgggttttaatctgcaaaattcgtacaggagaaccgacacaacatcttccgtgagaggttttataagataacctctccttgttgtcaccaatcgcccccttctgaacagttcgtattatttcaatgacccgttttatcagaatgctctccccctgcatacgaaacagcaagttccaaaaccctgctttttccttctcagcatttacgccgctcaatgttgtccctgcctgcctgactgccttcttttttgatcaacttccggcagatcaaattcgtcagactcgtcaagcgataaagctggttttactttatctacacctgttccggtttccattcgcgccatgcttgagcatacggaacaactgtttttgctatatgattttccctctatgcgcatctctgcaatttcagagatgcagacagccgcagaataaacgacaatcagcaaaaagcctccggatacccggaggcttttgattcttatccttgctgcgtgaacggccgggtctgtgtctttttgccccagccaagcgcggccagaaaactgatggcgagaatggccgctcccagcatatacggaaattccatatttacatcaaagagaaaaccggcggccgacggcccggcgatattcgctaagctgatgaatgaggtgttcatcccgccggcaaacccctgctggtcaccggcgagcttcgacagcatcgtattaacggccggccggagcagcgatgtcagcgtgaggaaaaagattgccgcggcaaaaacggcccaatatgaacccgcaaaccggcaccacacaagtcctgcagcagccccgatcaacgtcacgttaatgacgcgcttttccccgaacctgcggacgagataactgacgccgaccgcctgcacaaacacgccgatgagacccgcagccgtaataataaaagcaatatcagaggctttaaatccgtgtttatggtcaacgtaaaggccaaaaacggattcaaagttcataattccgaagttcagcacaaaaaccagaatcagcataaacgcgaacggcgatttgagcgcgcgtgacatttgcttaaacagatgctcacgtttttccgtttttgaccgggcttccagctgcttttcacgccccagcgtttcgggcagaaagaaaaatgaaagaacggttgaaaagcaggcgagacttgcggacacgatgaacggcacagacatgccgtaatgaaccaaataaccgccgacaccgggcccgatgacgacaccgagcgtcatcgccgcgctgaacagccccattcctttcccgcgttcttcctcggtcgtaatatccgcaatgtaagcgaacattgacggcattaaaaacgccgcgcccattccgcccaaaaggcgggatgcgaacaattgccacaggcttccggcaaaggcgaagatcaattgtgacacggcaaaggcggcaatgccgaaaataatcagtttccgccgtccgtatttgtcggttatttccccggcaataggcgcaaataaaagctgtgtaagccccgccgccgcaacaagcagacccatcgtgctccccgtcgctccgaattcggtaatatatgcgggcataatcggaataatcaatccgatcccaagcatcgcaataaacatattcagcattaaaattgacaatcgccccatgtacgccatgatttcttaccttctccccagacaaacagatgatcattccatatttgtcattttttataccattcagtataacggggaaaagggaaaaaagtccagatgatttcaatctcgttttcatatctcatgacagcacaccggtttcagccggcagatcatatatgttaagggccgcctgcagcgcttccccggctttaactgcaactccgtgtctgatcagaaccgcttcaagtccagccagcacaaacagcacattttcctttctgcagctgtagcccatcgttccgattctccaaattttcccctgcagcggaccgaacgagctggcgatttcaattccgaattgagacaaaagcatactcctgatcgattcgccgtctgcttccggcggaatcttcacacatgtgacgacaggcagcttcgcctccggatcgccgaataaatcaaggcccatcgctgcaagtcccgccgtaagcgctttttcatggccctgatgtctgcggaaccgttcttcaagtccttcttccaggacaaggcgcacaccctcccgcagcgcataaagcattgctgtcgcttctgtatggtgattcagccttctttcactccaataatcttcgagctggctcagatcaaaatagttgctcgtaaccggccgatgaccggacagcattttaccgtcagttgccgttgcaatgccacgttctacctttttacgcgcggcaatgacagcggccgtccggtcattataagtaatcggcgccattccggaagggaccgataggcatttttgcgttcccccgatgactgcgtcaatcttccattcatccgtttttacggcgcatccgccaatcgtggccacagcatccacgataaagagtgcatcttgggcgcggcacgcttccccgatttctttcagcggatgaatccgccccgttgatgtttctccgtgcaccatagcgacgattttcggggaaatctttttcatctcgccgataatctcttcaggccggaagaccgttccccattcacactcgatcgtatgaacgtccgctccgtaccgctcggcgatttcagtcagcaggtgtccgaagcgtccgtatatcggaacgagcacgctgtcacccggttctatcacacttgcgagaacagcctcaatccccgctcttgatgtgccgtcaatcggataggcccagcggttttccgtttgaaacaattcacggagcatttgcatcgtttcgttcatgataccggtaaatgccgggtcaaactggccgaggatcggagcgcccatcgccctcagcactctcggttcagcttctgtcggtcccggtgtcataatcgttctttgcggaatgcacaattcttttctggtcggcacgccgattccccctttacgttaataggcaagtttatgtaatacattcgccagcgtaaggacgccggtttcaagctgatgtgcgggtgtgaattcaagcggcgagtgactgatcccgccacggctcggcacaaacagcatgcaggccggaaaggttctgccgagcatctgggcgtcatgtcccgctccgcttacgatcttctccgggtccgccccctgctcttttgcagcctctgctgcggttcgtgtcagtgtctgatccatttgaaccggctctatcctcatatattcatcaataaagggtctgactcctttgctgcggctgatgttttcaataatcgacaccagtttctgacggaaggctgccagcacgtcttcctgctggtggcgaatatcaacggaaaactggatacggcccggaatgacattcgccatattcggctcaaccgtcattttcccgcacgtcaggcggagctcttccggctgtctttccgctgagagcatgagttcatggatgatgctgcttcccgccgcaagcggatctttccgccatttcattgaagtggtccccgcatggttgcattcaccgtcaagcgtaacggtatagcgtctctgtccggcaatcccggtgacaatcccgatatcctttcccgatcgttcaagcgtttgcccctgttctatatgaatttccagaaaggcactaatatcagtgcgcagcggcgccggataacggcctgcaccgaagccgttctgccgcatggcttctttcagagaaatgccggacgcgtctttcggcgtttccgcatctgaaagtgagaaagcaccggtgatattgcctgagccccaataggtgatgggaaaacggctcccttcctcttcacagagcgacacagcctccagcgtttttttcggacgcccgcacgtctcatgcaaatgccggatcgccagcatgcccgccagcacgccgaacgcaccgtcatatttgccgccgtcaataacggtgtcaatatgcgatccggtcagaatcacctcatcaggcgattctgtgccgctcagacggccgaacacgttaccgacatcgtcaaatgccgtttccagcccgaacgcctccattttctttttgacggcaagctgggcgtccatccattctttcgtatataaaagcctcgtcactccgccggaagcggaagcgccgaattgagacagccattgtatgtcatcggaaatcccgatattcgccgccgaaagctgctgatgttccatacacgccctccttttaaactgaaaaactgacaagatgatcttcattatagaaggagcgcataacgagttcattatcatatcttccaaaaaatcaatgattttccggatactttgaccaagaaaccgcgcctctgtcccataagccgaaggaaccatttttcaaaaaagatagaatattagatttattttttggataatagaggtaaaggagggcaagtcatgacaaaaaaactttggtttctgccgattgtctgcctgtttttcattttgggttggaccgcgccgtcagcctctgcgggcgcgccggctgacacgaatctgtacagccggctagcggtttcaactgccggcggcacaactttttttccgcaaacttcctcagctgtcatcactccgtctgcggatacggagacatattacaaagaagcttccggaaaaagcggaacagccttaaagagcgccctgcaccgcatcatcagcggacatacaaagctgtcttacagccaagtatggaatgcattgaaggaaactgacgaagatccggcaaacccgaacaatgtcatcttgctctacacccaggaatcacgggccaaaagtaaaaacggcggcagcgtcggggactggaaccgtgaacacgtgtgggcaaagtcacacggaaacttcggaacagctgccggccccgggacggacattcatcatctgcgccctgcagacgtccaggtgaacagcgccagaggaaacatggattttgataacggcggctcagaatacccgaaagcgccgggcaattattatgacggtgattcctgggagccgcgcgatgaggtcaaaggagacgtcgcccgcatgctgttttacatggcggtgcgttatgaaggcggcgacgggtatcccgaccttgagctgaatgataaaaccggcaacggctcagctccttacatgggaaaactgtccgttttgctcaaatggaataaacaagaccccgtcgacagtaaggaaaaacggcggaacgaaatcatttacgaagactatcagcataaccgcaatccgtttatcgaccacccggaatgggcggacgaaatctggtaatcgtatcataagaagtgataagggagccccatcatcaggctccctttttcaatatacggcgttttcagtgtcggcatcaaaaaacacggcccggttcatattgaccgcaagcagaatggcatcgccgggtttcacctctgaagcgccgtcaaggcggatcgtcatgcggtcatctccgctcaccgcatgaacgtacatctccgcgcctaagttctcacatatttccgccacagcgcggcacaccgcttcaggcgggtgctctgattgtccggcaagcgtcaaatgctccggacgcagccccgcagtcatctcctgaccgctgtatcctttctgcacaagaacggccgctttttctttcggaatgggcagacgaacggacgaaccggcaaaataccattgcccgtgactttcttctatgacgccttttataaaattcatactcggagaaccgataaaacccgccacaaacatattcgccggataatgataaatctcatgggggcttgcggcctgctgaatatctccttcattcatgacgacaatccggtcgcccattgtcatcgcttccgtctgatcatgcgtcacataaacgatggtcgctttcaaacgctgatggagcttgctgatttcggcgcgcatcgtcacacgcagtttcgcatctaagttggaaagcggctcgtccatcagaaacactttcggctcccgcacgatcgaccggccgagcgcaacccgctgccgctgtccgcctgaaagagccttcggtttccgcttgagcagatgcccgatttccaaaatatcagcggccgtccggactcgctctgcgatttcttttttcggcagctttctgagcttcaaaccgaacgccatattatcaaacaccgtcatgtggggatacagcgcgtaattctgaaaaaccattgcgatatcacgatccttcgggggcagatcgttcaccgcgtctccatcgatataaagcttcccttcagaaatgctctccagtccggcaatcattctgagtgtcgtagatttgccgcagccggagggaccgacaagcaccagcagttcctcatcctttacatctaagtgaaaatccttcactgccgccgattgggcgccgtatgtttttttgatatggtcaaatgttaatgatgccattcgaaacctcctccaatactggaaaccgccacatctttctgttatgttaaaaatgttcggggtttctgacagattcataaatgaaaagcaaatttgtattataacgtcataatacatataatagtactactacttgacaaaggaggtccgtcccattgttaaataacgggagctcgaaacctttatatattcagctgaaacaaattatcgcggacgatatcaagaagggcgtttattcgccgtccgtaaaactgccgactgaaaatgagctgtgcgaaacgtacaacgtcagccgcataacagtcaggaaggccatccttgatcttgtggaagaaggctggctcgtccggcagcagggaaagggaacgttcgttaaaagccctaaactgaagcgggagctcatcgcggtcaacggctactctgaatttatggaatcaacgggaaaaaaaccgaaacaccagatcctttcccatgaaatcattgaagcgcctaaatccatcgctcaaaaacttcgcgtcgcttccgaaagtcccgttcttgaattaaaacgcattttatttcacgacgaccagccgctctcattcgaaatcgcccactatccgctcagtttatttcccgacatcggcaagcatattaaaggcggcgtgtcgatgcatgacattttgaaacagcactatcaggtggtgcccacccataatacgaaactgttaaatgtcgtatacgccaagcaggaagaaagccgctatctggcttgtgatatcggggatgcgctttttgaaattgacaaaaccgcttttatgtcaaaagaacagccgatatacagttcgctgtttttaatgcataccgaccgcgtcacgtttaccattaacagcccctatgcgtaacaagtataaaaaacgagacaatgcttatcgtattctcgttttttcactgcttttcccgccgtccggcctgtagggatgcccgtaaccgaacgctccgaaccccccgcatgttttggcagccgtcccggcggccgcagtaagcgctcgccgaatatcctgatgttcgaagaaatcggtaagaaacccggcgataaaagaatcacccgcccccaatgtatctattatatcagctcttaccaccggctgatgatagacgcgttccccatccgataacaccgcgccatgttctccccttgtcagacaaacgattttcgctccgaaaccgcgggctttttcggcaagccgcacacattcactttcactcaaatcactcccggaaaaaaacgcatacgtcacatacggacagaccgcttctaaataggcttcgtcacgttttacagagaaatcaaaggaaatcggcacatggccgctcagcatcggaaggtcacgttctatcctgctgtatacgctcgtatgcagcagatcatgtccggcgataaatgagatgtcattctcctgaaaagcgagcgtcagacgcgattgcacgccgcctttatttgatccggcaaatatcctgtcccctctttcatcaagcgtgacgaccgccatcccgttttctccgtatgcccggcggatcagatcggcattcaccttctccagtttcagcacattcaatacgtgatccgccgcttcatcactgccgagaatcccgatataagaagtttcgtggcctaagcgccgggcaagcacggctacatttaacgcatttccgcccgggtaaaacgtctcctgatcctgataataatctactacattatctccggccgctatcagtttcatcttttcatcccccttatcctttcacgcttcccgctgcaatgccgcggataaaatatctctgcattaataaaaacagcgcgataatcggagcagcagaaatcgtcagcccggccagcagcacgccccaatccgtctgcagcgcatctctgaactgcatcagcccggccggaatcgtacgtaaattttcatcatcgataaaaataatcgcaaacataaactcattccatgtatggtaagccgtcaaaatgcctgatgtcaccagaatcggcacgctcataggtaagaatattctgaaaaatattccgaaacttgtacatccatccagataggccgcttcctcaagctctttggaaatcgacaaaaaataggaacggatcagaatcacggtaaacggaatacggtaggctgcgtacggaagaatcaatgcccaatacgtattgtacagtcccaatgactggataatggagtacagcggcacaagactgacctgcggcgtcagcatcaagccgccaagacaaatgatcagcacaaacccttttcctttaaattgaaaacgggccagcccgtatgccgcccaggcactcacaaatacggtgattagacaagtcagcacggtcacaatgacgctgttcataaaataagcggaaatcccttggttccatgcggatacgaagttttcgggatgccagacagagggcagcgaccagctgtgctcaaaaatctcatccgagcttttaaaggcgctgaccgccatccataacagcggataagcaacggcaatgaggtagataaagagaaacagccacacagacgtttccccgacataccattttctcggttttccgcctgttctgacggcctgacgggcatgacgcaagtccgtcttttcaggaagcatcggctactcctcctttccggtcttaaagaatttcatctgaataagcgacagagcaagcgtcagcaaaagcaccaccgtcgcgatcgcagaagcgtagcccatcatatcctttgtaaaagcgctcttatacaaaaatgtgctcagcacttctgaagcattgcccggccctccgccggtcagaatatacggttcattaaatacggtaaatgcgccggtcagcgtcatcaccacggcaacaaacgacatttctttcgtctgcggcaccgtaatgtgaaaaaactgctggatttttccggctccgtccagctgcgccgattcatataattcagcgggaatgctctgaatcgagacaatgtacagcatggcgatgtaaccgacagactgccattgagacacaaaaatgacagacagcatagcggtattttcatcgcccagccacgcccgggtcagttcatcaagtccgaccgcttccagcagctgattcaaaagcccgatttccgggttataaataaaatcaaacaacagcgcaatgacggtcatggaaatgacgaccggaagaaaaaataccgtacggaaaaacggcgaccattttcttaccaatctgtcttccagcacggccgccagaattaacccgccgccaacctggcaaatcagcgatatgaccgcatacagcacattgttgcggagtgctgtaaaaaacacgggatcgcggaacaggtcaatataatttttcaaaccgataaacgtcttttcgggttgaaatgagctccattcaaacagactgaaaaacacattctcaataatcggaatgtaaacgaacagcagaaaaaccagcgcgggcgcgagaaacagatacggaatgaaacgttttcggctgaccaaggaaatcctcatctcctttctccaaagaaatctgttctattcagatgacgctttgacctgacgcgccgctttctgcacggaattcatcacctcgcgcggtgtcattgtgccgccgagcatctgctgaacgcctgccgcatacacatcggcgatttcaacgtcaacatccatatcaaaccacggcaccattgtttcggcgcggacgatatcctgcacggcttcgcgctggatcggggtggaattgttttctgtcgccgttccctgaaccgcgctgtatttaccgacgtcttttatcagcttctctcccatttttttcgaggttaaaaactgaagaaattccatggcttctttcgggtgcttcgtttttgaggaaatcataaatccttcgggagatccggtcagtgcacggggagatcccttttcgccgctgattttcgggaaaggaaacaagcccagattgaccggttcgacgagcttaatttctgccgtttccgcataaatcatcgccgctttgccgctcgtaaactgctggcgcacgtattcgtgatcaacggagttaacgtgctttgtaaagtacggcagaagttcctgaagcttttcaagcgctttgacatagccttcgtccgtaaactccccggtttccgggctgtaatccttcgcccgcgttttctcatccaccatacgctggttcagcgtcccgatataatgagaaatggtccaaggcgcttttgtgccgaaactgatcggaatatatccgttctctttcaatttctcacagactgtgatcagttcatcccatgtcgccgggggcttcaaatgtaatgcattaaaaatgtccttattataaaagaatgatttagcgtccatttgccacggaacaccgtactgttttccgtcatgcgtaaagggtttgatttgtgactgcacaagctgtgaggaccaatctttatcctgctgatagtaagacgacagatcgagggctttatctcctttgatgaatttataagcaaaccggtcgctccatgaaaagaaaatatcaggggggctcgttgttccgagcatgactttcaccttgtctttataagaatcgtttaagaccgcttccgtttggatatgaatatccggatgagcggcttcaaaatctttgaccgcttcttcaaaatagcttttttccggctccttcggccacctgtgaaaaaacttcagggtcacttttccgtcagaggaactgctttggcttgaacaggcggcggctgacagacatacagctaacagaacgaacaggcagatgagctttttcagatgcttttcctcctttgtcaccggactataacgttatatatcattatagtccggtgaaatataatgcgcgttcttaatattcgactttccacatgtaacgccgctggcttaacggatggttccttgcttccgccagcgcatccgcatagcttctgagcacccggtttaatacgagaggagccaggtagccttttacagaatcgtcaattccggaaaaatcatatgctgccgcatcaagcacagtcagttttttgccgtatctttttgagaaggaaagcgcccgctcttcaaggggtcttgtttcgtctaagccgagcaggataataaatggaacggattcatcaatgatttcgaacggtccgtgaaaatattctccggcatgaatggcgtgggaatgaatccattgcatttccatgagaatgcagatgctgtaggagtaagcgacgccgtagttcgcaccgcttgccatcgtgtaaatgatatcttctttttcgtgggctttcgcgaatgcctttgcgtgatccgcttcttgtttaagcgctttgtcatatacggtctggagtttattgagtccgtcgatcgcctgctcaaacgcgggatggttttccagcacgtgtaaagcgccgaacacgatttgatacagaaccccgtaattcgtatttatcgcttgtgcgttctcaccccagtcatacaccgcgacatattcggcttctttcgctaacggcgaatcaggctcaaaggtcattgcaatcgtaagcgcgcctttttttctggcgaaaccggcggctttcaccgtttccggcgtattgcctgactgagaacataaaatcaccagagagttctctccgagctgaatgggattgcgctgaataaattcatttgaactgtagagatcagagctgatggctttcgcctctctgtcaaacacgtacttgctcggatacataatggctgaagaacccccgcaagcgacgaaaaagacgtggtcaatcgtttttcctttcagatcatccaagaaagcctgaaccttgtgattcacttgtgcggcagtttgactcaaatccttcactcctcagtgttttattatataatgttatataacattatataacgttatattaatcgcaacaaaggtgcgttgtcaatcatattttctgaaatttctaaaatatagaataaacccgtctaatttcccgccctctcttgacctgacccttagagacacgtttagaatgaaaagcagggagtgattcagaatgaatataaaagaagccgccaggcagacgggtctcacgaaaaaagccatcaaatattatgagcaggaaggtttaatcaacgtcagcaaaaaccctgataacggataccgtgagtattccgctcagaacgtgaatacgctgaaaatgattgccgccctccgaatgctggcactgtctgtaagcgatattaaagcgttcctcttagagggcagcagtctgcatgatatactgcgccagcagcatcaaaagctcagccggcagattgaagagcttgagcaggaacggaaactgactgaaatgctgatcaagcgcgtggaagatgcggaaaatgtcgattcaattctgcatgatatcggcgaggtcaaaatagatgaaccgaagtatatgggacttcagctgaaaaaactgttcccgggagatttcggagaatttatcgccgcgctgtttgaaccgttcctcgacttttctattgatacagatgagaaaaaaacgatatgggcaaagcttattaaagtattggatgatatggaaggagttccggctgcacacccgatgatgcagctggtcggtaaggaggacccggctcagctccagcagcacaaagtccagcatgaccaatttatcgagcggattttggagagagaccccgccacttgggacactcataaaaacatcatcattcagcttgtgaaaagagtggagacagatgaagagtacagagaaagcctgatcaagatcggagaatccgcttctgatctgcccgcgctgaaggaaggatcgcctttcagcaatctacttcaaaagctcagcccgaaatatgacacgtatgtgcgacttcagcttgaactgaaaaaagaagccgacgaggaactcggctttgattcagaagcatatttaaaacagatgcttcaatcaaaaaaacgctaaggctcgtctccttagcgttttctttcttcatcctcagtgctgtgcgttaatgcggtcaacgacattagcgatgagctgctcttttcctaaatcggaatcttcgtcaacgcttgctactgtcaaaatgatggccgctaccgcaagagcgatcgtctcaatggcggccgccgcgtttaaaaatacccatacagcacacagccatcaaataaatactgaaaaatgaactttttcacactaaaatactattataggtaaaaaagggagtgttcatatgtttttgatgaatgataaggtgctgtggggagctgtggttctcgcctttattctgtcgattgtgttttatccgtttcttcctgctgatatggccattcactatgacgtgtcgaaccgtccgaatacatcaatcaataaaacggccggcgtcctgatttttcctgtgctcatgatgatctgcatgttattcagaaaaaaggtcgtccagctgttcctcgtcgtttactgtctgctgatcgtgcatattgcagtgatgtggctggcactgtaaacataaagaaaaccggagcccttaagctccggtttttcttatttataaaatactttctcaatgttgtatttcgactgaagggtattgatcgcgtacgtttcgtaaatctccctttccatcggatcatggacgacacatacttcaattttatacacttcgtccctgtgatgtttaacaggcgacacattgtcttcaaaatgctttttgattctttgtcttaatttacgggctttcccgacaaacagcagctcatcatgaatgttataaaacataaagatgccgcctttgtctctcggaatttggtgaaaatcaatgaaaccgtaaatcgctttaatcgccggttcattttccgacggtgactgctgccgttccgtaatggttacatcaggaacaggaaggtttatttttatcaaaatgggtcacgtcctcttattcattaaagctccatcctatcataagaatgcgccaaaagctattttttattcaagcgccccggccggatcataaaggctcaaatcaatttccgtctgctggccgagtgcgagttttgccagttccgcccccagatacggcccgctcgtcagccctgaggcgcccagcccgttggcaacgaggagtccgctgatattcggcactttgccgatgacgggaagaaaaccgggagtaaacggcctgaaaccgactcttgtctctatcacagtactgtctgaaaggcccggcgccacggttaatgctttgtcaaaaatctcacggaggccgccggccgtcacccgcaaatccatgccggtatcgttttcatgagtcgcgcccgctacaatccgaccgtttgcaaacgcgagaatgtattgatcgtttgggggcatgacgacaggccagccgcccgtatcctctccctgaagctctaaatgaacgatctgtgccttttggtatgatactgaaaaacggatgccgagcggttcaagcagctctctcgcccaagcgccggccgttacgagaacctggccggcagtaagcgtgcgttctgcggttttcacaccgataacggcaccgtcctctgtcaatattgacgcttcttcattgtaaacagccgcgccgtgcttaacggccgcgtttaacagcgccttacgaagcgccctcccgttcacccgggccgcgccgctgacatgaaccgccccgtattcctccgacagcgcggggaacagtgccttcgtttctgccggagtcagtctcgtaatgtcaccgatttcaggagcgtcctctcttcttttataagctctttcctccatttggctgagctttttttcatccgtatggagactgacggcaccgaccttttgatagccggtgtccgtttctccgtcagcttcaagctgctgtatcaattggttataatagcgggctccgccttttgcgatcgcataccatgcctgattgcggcgctgcgacagccacgggcagacgatccctgccgcggcgtcagtcgcctgccccgggtgtttcctgtcaaagaccgttacatccgcacctgcctttgcgagatgataagccgcggacgcaccgagaatgccggctccgataatcatataagacttcatgtgtaacaccttttctatctgttttgtcttatttattttaacaaatagagcgcccggttcctaccggagtcctgacggcaatgataagtttcgaaaacggaaacgtataataaaaggaatacgttcttgtctgaaagccgttttcctcaagaattgctctgtattgtgatgtattttttatatctgacacggccaatgtgccgccaggcttcagcaccctcaccatttccgtgatcgcccgttccctctcttttctgcctgaaatgttgtgtgctgaattgaaagctttcccgagcgggatggtacggaaatcagtacgtatgaggaatatttggatagttcctgtgaacttgtgcttctcatcgcagattgctcgtatgtaacgttatattgcaaagatccggacatgctagaagccctttttcagcaggctgtacaatgcgggtttcaccgcgttgactatgttacagatgagaatgatgcgagaacgggattgtctgtctggtgaaggtggtgcgttctttttatgaagcgccggatagggcttaggattcaaaatattcacaaattcgtgtgttttcaacaaaaaaatcaccccctcatgtatactgagtgcgtaacttacatatgaaaggggtatggcaatgaaaatcagtttgaagaaaaaagcaggtttttggaagaagacggcggtttcatctcttattttcaccatgttttttaccctgatgatgagcggtacggtttttgcggccgggctgaataaggatcagaagcgccgggcggaacagctgaccagcatttttgaaaacggaaagacggaaatccaatacggatatgttgaagcgttggatgacggaagaggttacacttgcgggcgggccggctttacgacggctaccggagatgcgctggaagtagtcgaagtatatacgaaagcggtgccgaataacaaattgaaaaagtatttgcctgaattgcgccgtcttgcgaaggacgaaagcgatgacatcagcaatctgaaaggattcgcttctgcctggcgctcacttggcaatgataaagccttccgcgctgcccaggataaggtaaacgacagcttgtattatcagccggcgatgaaacgttcagaaaatgccggactgaaaacggccttggccaaagcggtgatgtacgatacggtgattcagcatggtgacggtgatgatccagactccttttatgccctgattaaacgcacgaacaaaaaaatgggcgggtcaccgaaagacggaacggacgagaagaaatggctcaataaattcttggatgtacgctatgacgatctgatgaatccgtcagatgaggacacccaggatgaatggagagaatcggttgcccgtgtcgacgttttccgcgatattgtcaaagagaagaactacaatttaaacgggccgattcatgtccggtcaagcgaatacggaaatttcactattcaataaacaaaaaaaccccgccatatggcggggttttactattaaccgatggagccttccatttcgaacttaatcaaacggttcatttcaactgcgtattccatcggaagttcttttgtgaatggctcgatgaagcccataacgatcatttctgttgcttcttcttcagaaataccgcggctcatcaagtagaaaagctgttcttcagaaacttttgatactttcgcttcgtgctccaatgaaatgttgtcgttcaggatttcattgtaagggattgtatcagaagttgatttattatccataatgagcgtatcacactcgatgtttgaacgggcgccgtccgcttttcgtccgaagtggacgataccgcggtatgttacttttccgccctgtttcgaaatcgattttgatacgattgtggatgacgtattcggtgcaaggtgaatcattttcgcacctgcgtcctgatgctgtcctttgcccgcaagagcgatagaaagcgtcatgccgcgcgcgccttcacctttcagaatgacagccggatatttcatcgtcaatttagaaccgatgtttccgtcaacccattccattgtcgcgttttcttcacaaaccgtacgtttcgttactaagttgtaaacgttgtttgcccagttttgaattgttgtataacggcagtagccgccttttttgacaatgatttcaacaaccgcgctgtgaagcgagtttgttgtatacacaggagccgtacagccctctacgtaatgaacgcttgcttcttcgtcaacgatgatcagcgtacgttcgaactgacccatgttttcagagttgatgcggaagtaagcttgaagcggtgtttcaaccttcacgcctttaggcacgtagatgaaagatccgccggaccaaacagctgagttcagcgccgcaaacttgttatcagtcggcggaatgactttcgcccagtgctcgcggaaaatgtcttcattttctttcagcgcactgtctgtgtctttgaagacaatgccttgcgcttcaagatcttctttcatattgtggtacacaacttcggattcgtactgtgcagaaacaccggcaaggtatttttgctcagcttcaggaataccgagtttgtcaaatgtctgtttaatttcctcaggcacttcatcccaagaacgctctgaacgctcagacggctttacgtaatacgtaatttcgtcaaagtttaaagagtttaaatccccgccccactgcggcatcggcatgttgtagaaatgctcaagagatttcaggcggaaatcaagcatccattgaggctcttctttcatgcgtgaaatttcttctacgatttcttttgtcaatccgcgctctgaacggaaaatggaaacgtccttatcgtgaaaaccgtacttgtattcaccaatttcaggcatttttttagccatccattttcactccaatcttttaattgccgcctttttcgccagcgactcctttttcaagtgctttccatgaaagggtggcacatttaatccgggccgggaatttcgaaacgccttgaagggcttcaatatccccgagatctattgagtcgtcatactctttcccttgcatcatgtctgagaaaatcttagacatggaaagggcggtatcaatatcttttcctttaatcgcctgcgtcatcatggaagctgaagccatggagatagaacagccttccccttcaaacttcgcttcctgaacggtatcgccgtcaagcttcattgtcagtcggatccggtcgccgcaagtcgggttgttcatatcgacgacgatgctgtcatccaaaacccctttgttgcgcggatttttgtaatgatccatgatcacttgtctgtataatgtatctaaatttgcattaaaagacatttgtaaagtactcctttgtcttttggagggcttccgcgagcttatcgatctcttcctctgtattatacagataaaaactcgctctcgcagtagcagatacatccagccatttcatgagcggctgggcgcaatgatggccggctctgaccgcaatgccctcagcatcgaggacagtcgcgacatcatgagggtgaacctcatcaagattaaatgtcacaagtcccgcccgctctttcggaccgtataccgtcacgccgtccagctgctcgaaacggtcaagcgcataggctgcaagcttatgctcatgccgggaaatctcgtcgagtccgatctcttcaagaaaatcaatcgcggctcccaatccgatcgcgcctgcgataatcggcgtgcctgcttcaaatttccacggaagctctttccaagttgattcataaagccctacaaagtcgatcatttcgccgccaaattcggccggttccatattctcaagcagttctttcttgccgtacagcacgccgattcccgtcgggccgcacattttatgggaagaaagcgcgaagaagtcgcaatccaggtcctgaacgtcaattttcatgtgcggtgtgctctgcgccccgtccaccacgatgacagcgccattgtcatgagcgattttggcgatctctttaatcgggttgatcgtgccgagcacgtttgacacatgagcgactgccacgatcttcgtatggcttgtgacagtctgccggacgtcgtccagcgaaagcgtgccgtcttcctgcatcgggatatattttaaagtcgcgccggttgcttttactgcctgctgccacggaatgatattcgcatgatgctccatttgggtgatgaccacttcatcaccgggttttaagctggcgcgggcatagctcagcgccaccatattcagtgaagttgtcgtgccttttgtgaaaatgacctcagccattgacttcgcattgataaacttacggactttttcacgcgcaccttcatagccgtctgtcgctctcgtgccaagagtatgaacgcctctgtgaacattggaattgtatttgctgtaatactgatccactgcttcaatgacagcacgcggcttctgggaagtcgccgcgctgtcaaggtacacgaggtcatgtccgttcacttgctgatgaaggatcgggaactgttcacgaatatcggtgatattcattattttactttcctttcgatgacggagacgagctgtttcttaactccttcaatcggaagctcttttaccaccggagcaaggaatccgtaaatgactaagcgctccgcttcttctttcggaattccgcggctcattaagtagtaaagctggatcggatccacacggccgacagatgccgcatgtcctgcagttacatcgtcttcatcaattaagagaatcgggtttgcatctccgcgtgctttttcactcagcatcaggacgcgggattcctgttcagcgtttgctttagacgcgccgtgctcgattttgccgattccgttaaagatggaagatgcggcatctttcatgactccgtgcttcaggatatagccttcagaagccttaccgaagtggatgatctgcgtcgtaaagttttccgtctgttctcctcttccgacaactacggttttcgtatcgccgtatgtgccgtctccgtagaggtttgtcgtgttttcagaaatcgtgtcgccgtcgttcatcagtccgagcgcccactcgattttgctgtctcgtccgcgcgcggctccgcggcggttgacgtatgttgtgacacctgctgacaggttgtcaacggcgccgtacgtcacgctggcattatcacctgtgaccacttcactgataatgttgaataccgcttctttcggattcaccgtgctgatgtagttctcaacgtaagtgacggagctgtggtcttcagcgacgatcagcacgtggttgaacaatgccgtgtcattgctttcatgaacgtaaacggcctgaacaggcgtctccacctgaacgtttttaggaacataaaggaatgccccgccgttcattaatgccgcatgaagcgcagtcagtttatgctcgtcgacctttacgccgtctttcatgaagtatttctcaacgaggtcgctgtgctcacgggcagccgttaagatgtccgtgaaaataacgcctttgtctttcagttcttttgaaagagaaaggaaagcaggcgtttgatcacgctgcacatataacgttttatcttcgttttcgatatcgatcagcgcttttgcttcatcagctaaatcttctaaagaagcaagcggcgcgttttctactgtatgcttgttgaactttgtaaagttccaatttgtgatttttgttttatcaggcttaggcagcggcagatcttcagctttttcaagagcctgtaagcgcaggtttttcagccaggcaggttcttgatgcttttcggaaaagcctttgacatattcctgatctacggatagtttcgtttccaatgtcatgattatccccctaacgcttacgcttcttggcctacagtttcgtcttcaatgcctagttcctgtttaatccagtcataaccttccgcttcaaggcgctgtgcaagctccgcgccgccggatttcactacgcgtccctgcatcataacgtgaacgacatcaggcgtgatgtagttcagaaggcgctggtagtgagtgatcattaagcagccgaagttttcgctgcgcattttgttgattcctttagaaacgactttaagcgcatcgatatcaaggcctgaatcgatctcgtcaagaatggcgattttcggctcgatcatcataagctgaaggatttcgttgcgttttttctccccgcctgagaaaccttcgttcaggtaacgctgcgccatttcagggtccatttcaaggaactccatgttttcatccattttgcggatgaatttcataagagaaatttcatcgccttcttcacggcgtgcgttaatcgcagagcgaaggaaatcggcatttgtcacaccgctgatttcgcttgggtactgcatcgcaaggaaaagacccgcctgagcgcgctcgtccacttccatttccagtacatctttgccgtcaagcgtgatgctgccttttgtaacttcgtatttcgggtgtcccataatcgctgctgagagcgtggatttaccggtaccgttcggccccatgacagcgtggaattcgccgccttttatttcaaggtttacaccttttaagatctcttttccttcgatttcaacgtgaagatccttgatcgttaatgttgaagcagccatatctatacctccaaaatatataatcattattctcaatttattctcattctaattttataacaaatgaaaagtaaatacaactttttatattacccggaacattcctaaagtttatcaaagatcaaggcgtaattaaagctgtttgaaacagaaaaagggcggaaatccacccttttttactgaccgattttctcattaagctgcgctgcgaggaacttgcttttttgatattcaagctccctctgccgttcgacttccatcctttttgaaagacgccgtccgtattcctcgtagccgatgccgtgtgacttctgcatcgctttttccatttcaggcgtatagtcaaggtccagtctctcttggctggtgcagataatgaatcaatcccttcatatatttgtttctattgtaacaatgatccgctgctccggccaaagagggtgtgcccctgaatcctttcgaatgtgccggaaaccggcgctcgctttatctgaaaaacggtattcacacgattgctcattctaatgcgtcgtatgtccgaattcctgaatacactgctgcacgagggtcactccctgactgagagccgcgccgcccccgaatgccgccgcgacgctgatgacctcaaggatgttttcttctgtggccccttggtcaaggcagcccttcgtatgataaatcatgcaaaattcatcttgagcgctgatgctgatgcccagagcgattaattgtttctctttttcagttaatgaatccgctgagaaacactgctcagtaaattcattaaacttccgccccatcatcggcattttttgctcgaatatgcctaaaccttctttatattgtttcaatgcgtcatgcacgctttttccgttatcctggtattgagccactgccattccctccaatcgttaaccttcctttttattatggacagttctccgattaatacccgaaaaaaaccccggatgattcatccggggttttcgctttattcagatacgggaagcacggctccgtcgtattttttctcaataaagtctttgattttcttagagtgaagcacttccataagcgctttgattttctctgatttttcgtcacctttgcgtacggcgatgatgtttgcgtacgggttgtttttcgttgattccacttgaatcgcatcttttaacggattcagtttgttttgaatcgcatagttgacgttaatgaagactgcatcgccttcttcttcattatatgctttcgccgttaattcaggggcgatttttttgaatgtcaggtttttcgggtttttcgtaatgtttttcgtagtcgcttcaatcgtttttaccttcggatcaagtgtgatcagtccggctttttcaagcatcgccagcatacggccttgttcagcgacattgttagtcatgatgatggtcgcgccgttaggcaggtctttcagtgatttgtattttttcgtgtaaactccgaacggctcaaggtgaacggctccggcattcacgagtttgtaatctttattttctttcatttcctgttcaaggtaaggaacgtgctggaagtagttcgcatccacttcattatcagctaacgctttgttgtacattttgtaatcgttcagcacttttacttttaatgtgtagcctttttccttcaagagcggttccgcttcttttaagatttcagcatgcggtgtttttgtcgcggcgacaacgatttcctttttattcgagccgtttgatccgcaggcggctaaaactcccgcgaacacaagcagcagcgcacttaatacaatctttttcaatgtaaatcctcccttatcttttgtctattatatttgtaattacatcaccgataatctgaatgataaagacgatgatgagtataaatactgtcgctacaaacgttacatccgtattattggactggtagccttctacatatgcaaggtttccgagtccgcctgaaccgatggcgccggcaatggcggtagatccgatcagggcgatggccgtcacggtgatgcctgaaattaacgcaggcattgattcaggaatcagcactttgaagataatcgtcgatgtctttgctcccattgatctggcagcttcgatgactcctttatcgacttcccggagcgcaatttccgcaagacgggcgtaaaacggcgcggagccgataatcagcgccggcaatgcggcattcggtcctaaaatcgatccgaccagaatcttagtaaagccgagaagcagaataattaaaataagaaacggaatagacctgaaaatattaacgaccgccgcaatcacggtgttaatgattttattttcccataagcttcccttgcccgttaaaaagagcagaagaccgagaatcgctccgatgataaatgaaaaaactaaagcgatgaccgtcatataaagggtctcatatgtggccgtccacagctcggttatatcaacgttcgggaaccatttttcaaacatttgtgatcacctctgcttctacctgtttgtctttgatgaaccggatcacgttttctacttctttttcctgaccgtcaatatgaatgaataatgaaccgtaagctccgtccttcgtctgtgaaattttcccctgcagaatattgacgtccacatcaaagtttcggatcatttccgtaatgaggggctgctcggcggcctgcccgacaaatgaaagctgaatcgttttccctgtcgctgtttcctgcagaaaatgctggatggtttctttcgtctcctccggttctgtcacctgctgaacgaaacgcttggtcatcggttcgcgcgggtttctgaaaacttggagtacttcgccttcttcaacgactttcccgttttccatgacggcgactctgttgcagatttttcggatgacgtgcatttcatgggtaatgagcacgatcgtcagaccgagtctgtcgtttatatcggataaaagatccaaaattgaatcggtcgtctgcggatcgagcgctgatgtcgcttcatcgcacagaaggactttcggattattggcgagcgcccgggcgatgccgacacgctgcttttgaccgccgctcagctgcgacggataagatttttctttcccctctaatccgaccagtttaatcaattcatcagcgcggcggacccgttcgctttttttcacgccggcgatttccagcgggaacataatgttctcccggacggtgcgcgaccacaaaaggttaaaatgctggaagatcatgctgatttcctggcgcgcttttctcagcccgcggctgcttactttatttaattccgtccccgcgacttccacggttcccgacgtcggcttttcaaggccgttcaggagacggattaaggaacttttaccagctccgctatatcctataattccaaatatttcgccctttttgatatcaagagtgacatcttggacagcattgacatccccatgcttcgctttgtaaatttttgaaacattttgaagatggatcaaagcaatcacccgccttacactattctaagaaatcttccgggtttctccgcaaaagaaaagcctttctgcaaaaatgagcagaaaggcttattgaaaaaggcctttctctcatctttcaaagcagaccgcttcgagtgaattggcaccatttcaacattgttgatggttgccgggcttcatagggcacttccctccacctctcttgataagagaaaacatatcgtattttcgtccggaaattcttactgtagaatagcacggcgaatgataaaaagtcaataaaataaatattggaagctattgtcacatagtagattggcagttacggccgtttactgatcgcctgaaaaaatccgtttgtcagccagaggatggcctccagcttcagcagggctctgaatgagcctttcactttgagttttccgctttggataagcttttgcaaagagacatcaccatgcaggagatggatgatttccgtctggtttccgtaaaaggtcaaattagatttctcctttgaagccgacgtttttctcatttctccctgtccgttaattgagaccgttaaggcttctgtttctccttggaatgtaatcagcagcgttgaggcgtttaatagcggtttcaaaaacagatgctgtccgtcattctctgaaacttctattttctccactcgtataacctcccgttttaatggccatacatacactttctctttttaacggacagaaccctttataaaccgcacgacattttcctgtaaatattgtcacatcgggaacgtttgcgatgttttttgtttaatcagctcatataaataggaaacggagcggaaggcgtatcctttctcaacaagctctccgcctttaaacagcaaaaagcacggaacgctttcaatctgataggctttggcgaatgcgggggaataattcacgttgtttttatagaaggcggcaccgggcagcatttcttcgacgacagtaagcattttggacgccagctggcatgtgccgcaaaacggggtgtacaaatacaggagataaacgtcatcctgaatcgattcgagttcattttcttggagttctttcatgattaccacctcaggtcgttctttttcaaaaatacagtgtcagcatcaaagccggctttgatcagcacagatgcgagatgatggcccgggcacgactcgacttgcctgtatgttctgtctatataaatatggcgcgcttcgggaagctcccgtttcagctgttttcttaatttttctccggagtcatctgcgtccgttaaaatatagacgtctctgtcaaacaggcggtccgccaactcttccagttcggtttggccgatcgtcccgtttgtacagacgatttccgcgggttcgatgagcacttccctgactttgattttatcagattttccttctacgataatgaccttttcatctccgttgtacataagcgcgtcacctgccgattgttttagcgtcagattgaaaaagaaggcagtgaaattcaccgccaactgttaacaccagccattctcataatcgcaatcgacatatttcggatcgctgccgtttatgacatcggctgttttataaaatttttgattttcaaatgaaaagccctgtttgagctcgtactggtccatgcctgtcatctcgccgatggcttcattttcatgaaacaaggaaaaccggccgttttgaaagcggcccgtgacgttctccgtcacatcgaccttttgtttatcaaaagccattttagacacctcccgttacagatagagtgtccaaatggcccctttgctatccgatcagtcttcctgtgtcatttcgtcatattgctcagaagtcatgaggttttcgatttcttcagcatcagccggttccacgacgatcatccacgctttttcatacggagactcgtttacgaattcaggactgtcatcaaggtcttcgttcacttccgtcaccgttccgttaatcggtgcgtacagttcggatacggttttgacggattccacgctgccgaatggctcgtccgctttaatttcggcgccgacttccggaagctcgacaaatacgatgtcgccaagttcggcttgcgcgaaatgtgtaatcccgatacgggcttttccgtcctcaactttgacccattcgtgctctttggaataacgcatatctttcggtgtgctcatctaaatccctccatttttttcttataataagaagataccataattctttgaacctggcattacatccaatatttttcgaattggtcttctttaaagccgacagtgactttttcgccgtctgtcgtaatcgggcgtttcaggagcataccgtctgatgccagaagttcgagctgtttatcctctgacatatggtacagtttttcctttaagttcagctcgcggtatttcattccgctcgtgttgaaaaactttttgagctcaagaccgctcttttcatagaggtctttaatttcttctttcgacggagtttcctccgcgatatgtatttcgtttatttccttaccgcggtcttccagccattttttcgcattacggcacgttccgcatttagggtaccagtaaaaatttaacgacatcttcttcaccccttgtaaatgatcgtcgttattttaacacaatcacttgtaaaaacctataacgttgcttcatgaaaaagcgcccctgatgaaggagcgctttcagcatgtgatcagactgtatatttttcttcacggaagacggctgctgccgcttcacgttttttctgaatgaggtttttcggcgtcaggcgcgtcagtttgcgcagcacggaaagcatcatgcggagggaatctccttcctccatggcgatcagtgattctttggcgtgcgcttcaatgttctgaagggcttcctgggcaaagatttccgtatataacagcttctgcgcggctttttcggcaccgtccgccgcaattgctttttccgttctgaggacggcagattccaaagcatacagcgcgctgacaatatcggcaatgttcaccatgatttcctgctcgccttcaatctctttgccgtatttctgcgccgcgagacccgctgtcaagagggcgatctttttcgcctgtctgacaatgtatttttcctgttcaagaggttctgagcccggctcttcaggcatcagcatcatgagttcttcttggagcgcttttgctttttcaaagagcggcagctgaccttttacggcttttttcagaaacgtgctcgttacgatcaggcggttgatttcatttgtgccttcaaaaatcctgttgattcttgagtcgcgataggcgcgctccacttcatattcctgcataaatccgtaaccgccgtgaatttgaaccccttcgtcggcaatgtaatcaagcgtttcagaaccgcacattttgttgagtgagcattcaatcgcgtactcggcgatggacttcgcgacttcgcgtccgtctttttgctcctcttccgtcagtctgctcatattatcttcgaataagcccactgttctgtatacagagctctccatggcgtaaagccgcgctgacatcgtcgcaagcttttcctgagtgagcgtgaagcttgagatcggcgttttaaattgccggcgctggtttgcataagcggcagacagctcaatcacccgttttgaagcgccgattgtgccgacggcaagcttgtagcgcccgatattcaggatattaaaggcgatgacatggccttttccgatttcgccgagaagattttctttcgggacttccgcctgatctaaaatcagcgttcttgtcgatgaacccttaatccccatttttttctcttccggtcccgttgatacgcccggatagttcttttctacgataaatgcggaaaacttatctccgtccactttagcgtagacgacaaagacatctgcaaaggcggagtttgtaatccattgcttttctccgttaagaatatagtgtgtgcccgcttcattcaaaacagccgtcgttttcgcgccgagggcatctgaacctgaaccgggctcagttaaggcgtatgccgcgattctttgtcctgaagccaagtccggcaaataggtttttttctgttcttccgttccgaagaacacgatcggcaatgaaccgatcccgacgtgagcgccgtaagatagcgaaaagctgccggcacgtgaaaacttttccgtaatgaaggctgaactgattttatccaggccgattccgccgtactcttcaggcacgtctgctccgaggaggccgagatctccggcttttctcagcagtctgaccgaatgctcaaactgatggttttcaatttcatcgatataaggaagcacatcgttgacgacatagtcttctgtcgttttgccgatcattttatgttcgtctgtaaagtcctccggagtgaatatttgatcatatcccgtctcttcaatcagaaagctgccgccttttttgacgttgaccgtttcctgtttcatgttcatttccccctttttttaaatgagttcaaatacgccggcagcgcccatgccgcctccgatgcacatcgtcacaacgccgaattgctcgtttctccgtttcatttcatgaatgagtgacagggtcagcttcgtccccgtgcagccgagcggatgtccgagcgcgatggcgcctccgttgacgttcaccttttcttcatctatcccgagcgatctgatgacttgaatggcctgtgaagcaaaggcctcattcaattcaaaaagcccgatatcctgtaattcgagtccggcaagcttgagcgcccgcggaatggcttcaatcggaccgatccccattacctcaggcggaacgccgcctacggcaaaggaacggaatttgacaagcggggccaatccgagcgacgatgctttttcgcgatccatcagcatgacagccgccgcgccgtcacttgtttgtgaagagttcccggccgtcacggttcccgttttagaaaaagccgggcggagcttcgccaagacgtcagccgacgtgccgggacgaacgccttcatcctgagaaaaggtaaattgttttttccgcggcttatggtcatcaccgacttctgtcagcgatacttcaaccggcacgatttcgtcattgaatttcccttccttaagggcttttgcggcattctgatggctgcggactgcaaatgcatcctggtcttctctggataccccgtacgtttcggcgacctgctccgccgtatgccccatgctcatgtaatactcaggcgcatgctccgccaaagcgatattcggccgtgtcacatgccccatcatcggaacttgcgacatggattccgcaccgcccgcaatgacggtatcacccgcgccgatcataattttttcagcaccgtaagcgatggattggagcccggaagagcagtagcgattcaccgtaatggccggcaccgtatgaggaagccccgccagcgcaccgatattccgcgccatatttaatccttgttcggcttcaggtgttgcacatccgataattaagtcatcgatatttccttcatagccgcctgcccgtttcagcgtttcttttacacaaagcgcgcctaaatcatcaggacgaacggctgcaagcgatccttttttcgctttaccgaccggggttctcgcaccggccacaatgactgcttctctcataaacaccctcctagttccgtaaaggtttgcctttgacgagcatatgctgcattctcgcttgagatttcgcctcgccagcgaggcttaaaaaggcttctctttcaatctcgagtaaatattcttctgaaacctccgtgccgaacgggactcttccgccggcaatgacatgggccagcttcttcgcaatcttcatatcgtgatcggataaataacccgaccgtctcatttgatctgctccgagcagtaatgccgcacagccggtttctccggtaactttcacttttttgcgggcaggcggacggtatccgctgtcatataaggaagcagccagctgtttcgcatcgtgcagcaggtgatcctgattcatgctgatacggtctgccgcggacaaaatcttcatgtcacgggcttcgtgtgccgaaccggacaccttggcaagcgcgattgtttcgaaggttttaatcgctgcgtccatgagttcacttccgccgtccaaataattcatgtacagctctttgtttcctccgccgcccggaataaggccgacgccggtttcaacgagacccatatacgattcgctcgccgcctgaacgcgtgccgccgggagacagacttccgtgccgccgccgagtgtcatcccgaatggcgccgctacaacgggtttagcgctgtatttgatgttcagcatcgtctgctgaaaacggcggatgacaaaatcgacttccatgaagttatcatcctgggcttccattaaaatcatcgcaaggtttgctcccgcgcagaaatgtctgccttggtttccgatgacaagacctttataattccgctccgtttcctcaagcgcattgtcaatcatctgaataatgtctaagccgatcgcgttgcttttcgtatgaaattccagcagcgcgacatcatcgccgagatcaatcagacttgcgccgctgtttttagtgataacgccttttgtttcttttaacgtctgcaggctgatccgtttcggattttctttcacagccctgtattggccgtctgaataataaaattgtgttccgttttccttcatataaaatgtttcatgaccctgattaagcatttctttcacccagccggggagtgctgcgccttcttcttcgagccgatccgctgattttctgacgccgatggcatcccacatctcaaacggtccgagctcccatccgaagccccatttcatggcgtcatcaattgctttgatatcatcagcgatctcacctaaaagccgggctgagtataagagtgtttgcgatgtgatattccaaagcaggcgtccggcgcggtcatcggaatatacaagcgctttcattttgcctttggcaccctttgcctgtttggcggcttctaaagcgggcgtcttcattttcgagcgctcaccgtatgtcatggtcagcggatcgagttcatatattgttttaccttcttttttgtaaaaaccttggccggatttgctgcccagccaattgtttttcagcatgtcattcataaattcaggaagcttaaacatgtctttttcagcgccgtcggctttatcatatacgttttttgccacatgagcgaaagtatcaagccccacaacgtcaagggttctgaaggtcgcacttttcggtctgccgatcaaaggcccggtcaccgtgtccacctcgccgatgcggcagccggaagaaagcatttctcttaccgtgaccagcaggccgtacgtaccgatgcggttggcgataaagtttggcgtgtcttttgcgatgacgacacctttcccaagcgtgttttctgcaaatgaagtcataaactccagcacgtcaggatctgtttcctgaatcggaatgatttccagaagcttcaagtagcgggccggattaaagaaatgggttcctaagaaatgagccttaaaatcggcagatcggccttccgccatttttgtgacggagataccggacgtattgctcgacacgatgcttcccggtttccggtattcatcaacgagtgagaaaatctgtttttttacgtcaaggttttcgacgacgacttcaataatccaatcagcatccttcaattgagctgcgtcatcttccaaattccccgccgttatatagtcgagattggcagccgaagtcagcggcgccggtttttgcttcagcagcttttgcatggccgatcggctcagtctgctgcggacctccgggctttctaatgtcagcccttttttcatctcatcctttgtcagctcgtttggcacaatatcaagcagcaggacgggaattccgatgttagccaagtgcgcggcaattccggaccccatgacgcctgatccgagaacggctgctttctttataaacttgtgcatgagtcatcccccttgaactttgaatgaatagtcattcattttttcggcaaaaaaaatgaaacccttttcttctttcatcttaaaagattttcaggatgacttcaatagcaaatatggaatttttttaaatttttcggcttccgcatgttccatggcgcgggcgggaaacttaaacccggaggtgaagggaatggtgcgagggagaaaagatccgtcttctgccgcagtgagcgcggccagcatgaaaggaaatgcgggaccgaagcaaaaatacggcggcggcaaacggacgagccaaaatcagcaatataaaaaagacaacatggaataacatactgcggctgctttttggagcagccgttattttttgaagattcctttcagcacaaacgccgcatttgccgggcgctcggcaattcttctcatcaggtacccgtaccaatcggttccgtacgggacatacaccctcatcctgtatccttcttcggcaagctccttctggcgctccgttctgatgccgtacagcatttggaattcaaactgctcccggggaatctgatgctcactgatgagtgttttcgtatacgaaataatgtcgtcatcatgtgtcgccaccgccgtttcatagccgctcaaaagctgcagcttaatcagctgctggaaatgaagatcggttgcttttttatcagggaacgcaacggccgccgattctttataagcgccttttacaagcctgagccgcggcttatatggcatcagaccgctgatgtcttcagctgcgcggtataaataagcctgaatgacggtgccgagcatcggaaaatccggcttgcaccgcttatacagctcaagcgtacggccgcatcttgaatagtcctccatatcaatcgttacaggcacgccgcgttcttttgcctccgtcaatatgtctctgacatgctgttccgcgagttcctcggaaatatccagaccgatggatgttaatttcagcgacagctcgcaatccagttgattctcggcaatcgccctgattgcttttttacattcttccgccgtccttttcgcatccttctctgaacccgcatattcacctagataatcaaccgaagccgacagccctttttggttcagccgctttaccgttttcacagcttccgtgagcgtttcccctgcaacgaaccttcccgcgccgaagcggattccgtaagcctgggcgaattttgtaagcattttatttttcgacaaaaataaacatatgctccgcagcaaagatgaactccctcctttttcttttattcgtgtatgaatttccggtcgcagagaaagctaaaacacaaaagccatgcagattgccaagatatcattcatatatccatacagactctgatgtcaaagcaatgtattatattatcaagatattcaaacggttttaatgagtcacaaaaaggatcaataaaaatcactacttcttcaattgagttttcgagctataattccgcttcttcgttacatttcgcccaaaaaaacttttaatttatatttctttatccccttataatttgaaaatattccttaaaagataattgatttataatttacaatggcttatatttaaaattgataattcagtttattgaacgtatctattaagaaggaaaagcagaatttcaaaatgataattctgctgaatttatctttgcctcacaaacatacctccaaagcattattatttctttctaatagctttacgatccttcatctttaaagatggcttctcttccctaacggaatttaaagaagggacctgcctgagttatccattcaccttattttgaagaatcactaagctcgaaacatatgaaaagagggaaccttcaattggattcaacaggaaaatctaaacgtacacttttattaattggacttattatagctatgtttttttctgctctggacggaacaatcgtaggaacggttatgcctaagattgtaggagatctcggcggcctgagcatgatgacttggctgactacggcctacctattaacatctacctccatcgttccgatcgctggaaaacttgcagatctattagggcgccgggcagtatatgtggccgggctgattatattcatgattggctcttcactgtgcggcctggctgataacatgaaagaattaattgtgtttcgaggtttacaaggtcttggcggaggcattatgatgccgatggctatgattgtcattggagatttattcacaggcaaacagcgtgccagatttcaaggcgtatttggcggtatttacgctcttgcttctgtaatcggtccgcaaattgggggatggattgtagattctttcagctggcattgggtattttttatcaatttacccgtgggaatggtagctgtgttctttattgcgatgggattgcaggccagaaaatacacgggtccgattcattttgatttcatcgggatgtttacaatgattacgggtgtagtctgtttgctgcttacactcagtttcggcggaaaagaatttgactggttatcatggcagacattttgtctgttagctttggccactataagtattattagttttgtatttgcagaaaaaaaagctgcagaaccaattctgcctatacatcttctaaaaagcagaacttttatcttcttaaatttaatagggttctttatgagtattgggatgtttgcagcaatcaccttcgtccctttcttcatgcaaggaataatcggcatgagtgcatcagagtccgggacaatcatgatgccgatgatggtcgcaatgattatctccagtattataggcgggcagctggtctttaaaatcggcattaaagcgcagattatcacggggatggcaatcatatcctttgcctattttttattatccacattagaagctgacaccagcaaattaactgcaactacttatgtagctatcatcggcttcggtatgggccttgttatgcccattattactctggcacttcaagagagtttctctaaagaaacgctcggcgtggttacttcgtcaagccaatttttccgctctatcggaggtacgtttggaattacgattctgggagcagtgatgaatgccaagtcaggaaatatattaaccgataaattagttccttttttagacaattttccaaaacaagaaaacgcattagcagctcatctcaaagacttgatcagcagcaatcctcaagtcctgctacagaggctattcagttctggttcattcgaacaatttccgcattctatagcaaagcacatcataccgataatgaagacagcgttaatggactctcttcgcagtgtatttttcgcagggcttatactattaattgccggagtattttctgcttttcttttaccaaaaataaaaataactgaaagaaaagccggcactgatctagacaataaaccggcagctgaagtccaatcctagtgccgctgctgactttcacatatatcgaactgttaacatgaacagacattatccgaaggttttttcttctgatagtgtctttttttattgtaaatattgatgtctctcctgcaaatcgtggttattttaatttatctgtatgaaatcccagtcgcagagaaagctaaaaagaacagaattgaaggaggcgtttatatgaacaaccaagagcagcacggaaacttgccgcctgccgtcatctcaacgaaagaccatttgtatcttgaggacatgctgaactggaatctgcttgccatgaaaaaagcgcattttatggcggaacactgccagaatcagacgttaaaacaagagcttgatcagattggccggatgcatgagaagcattatcagcacatattgggccgcttgaaccccgatcaaggcggacagacaacaacaggctacatgcaataggaggacaatacatggaacagcaaaatcaaaaaatcacgaatccgcaaacgcccgtgcccaatacggcgcaaatgaatgacagagacttggtcaatgagctgctgacgacggaaaaatacatcacggcttcatattgcacagccctgcacgagttcagccacgagtctctttatcaagatattcaggcgattttcgatgagtcacaaaaagcgcaaagaagattatacgatgtgatgtttcaaaatggctggtattccattgaagccgccgatacccaaaagcttcagcaatcgtatcagaagttccggcagaccattcagcagcagtctccctaccagcagtaaaatgaaaaaggatttgatgttttcgccaagcatcagtcctttttttatttttgcacaaaaagattgacttatcattaatccttatttatatttaactaatgttaattattttctcgaggaacaagatgaggaggagttatgaaaaacgcggatcaatatgtgtctgacatccagaaatctcttcagacgctgctgcaaaacatacagcctgaaatggtggaaagcatggcaaaacacgaggtgacgcctgcccaattatttgttttagccagcctgaaaaaacacgggagctgcaaagtttccgaaattgcggaacgcatggaggtaaagccgagcgcggttacgctgatggccgaccgcctcgaacaaaaaggacttatcgtccgcaaacataaccagcaggacagacgcgtcatcgacatcagcctgaccaaaaaaggcgaaacaaaattcgaagatgttgtggaaggacggaaagcgatactggcgcgaaacctgtccgttctgactgacgatgaactgattcagtccgtgaacatcatccgcaaagtagcggaagccgccgagaaatacgcggctgatcaaaaagaaaacgaatagaaagaggagctgccgaaacatgagcattgaaaagaaagatccaaaacgcacattattaataacaggcttaatcatcgccatgtttttctcagcccttgacggcaccatcgtaggaacggcgattcctaaaatcgtgggtgacctcgggggattaagcatgatgacctggctgaccacggcatatcttttaacttcgacgacgatcgttccgattgcggggaaacttgcagatttattggggcgccgcgtcgtctatgtgtcaggtttattgatttttatgggagcttccgcactgtgcggaatggccagcaacatgacggaactgattattttccgcggacttcagggaatcggcggcggtgtcatgatgccgatggccatgatcgtcatcggggatttgttcacagggaaacagcgtgccaagttccaagggcttttcggggcgatttacgggcttgcttccgttatcggcccgcaaatcgggggctggattgttgactcattaaattggaaatgggttttctatatcaacctgcctgtcggaatcttagccgtgatctttatcgcaagaggacttcagggcagaaaacagactgggccgattaactttgacattgccggcattttcacaatgatcgtcggaatcgtcagcctccttctcgcgctcagcttcggaggaaaggattacgcatggggctcttggcagattctcggtctctttgcgcttgcgcttgccgggattgtcggattcattttcgctgaaatcaaagcaaaagaaccgattctgccgatgtacctgtttaaaaacagaacgtttaccgtactgaatctgatcggctttttcatgagtatcggcatgttcggcgccgttacgttcgttcctttctttatgcagggaattatcggagtcagcgccaccgcgtcaggcacgattatgacgccgatgatggtatctatgattatcacaagtattatcggaggccagctggtttataagatcggtattaaaccgcaaatcatgatcggcatgctgatcatggccgtcggcttcttcttattaacgaccttacagctggatacaagcaagctcgcggctacgtgctatatggccgtgatcggtctgggaatggggctcgtcatgccgcttctcacactcgctctgcaagaaacgttttcaaaagaagagctgggcgttgtgacttcatcaagccaatttttccggatgatcgggggaacgttcggcattacggtgctcggcgctgtcatgaatgccagatcaggaagccttttaaccgacagactggtgccttacttagactcactcccgaaacaggcaagtgcctttgccgcccagtttaaaggtatgattgacaaaaatcctgaagggctgcttcaatccttgttcagtcaggaatcgattaagcagatcccggccgcattttcttcccatatcgtgccggttttgaaaacgtcactgatggattcgcttcacagcgtgtttttcacaggcctggcctttatcgctgccggattgatcctcacgctgtttgttaaatcaattacgctgacaaacaaaaagacaggcaaacaagaagaaaaggcgaaagccgtttaacaaagaaaaatcccgcggatgccgcgggatttttttatatcatctgggcctctccgtttccgaatgaccagtcttccgcctcattggaaatcgggggggtgaaaattatttaataaaccttaaacatttcatagttatctttatagtacgacaaaataaagtcacgaaaatttcttaccgaagaagataacagcttatgtttcatccaagataagccgactggatatgaagcagagtgatcagtcacttttataaaattcagccccaatgttctgcaaaccgaaataggaagcaacgccaccccctgatccagctttataatctcggccagtaaatgagaatccgcctcaaatgcaatatttggggtgaaaccggctttctcacaaagcgaggctgtaaaaccgctatactcttcattattagcaagggtaataaatggttcatcggcaacaagacgtaaagaaatttcggttttacccgtaaatcggtggtttgagggcaaagccagaacaatatcttcatttaccagcatacaactttctatctcttcatcttgaatcggatgacctgttattcctaaatcaatgtcccctttttttaaacttgttaggatcccgcttttaactccgatggcttggagaatttttgattgaggggagcggttgatatattcactcatcagtcctgcaaggaatctcggattagaaatagatattctgatggtgtcagacatttgatgttcctccaattgaatttccgtttgtgcattttcaatctcagtaaaaatcctgtttacatgttttaaaagaattttccctgatgaactcagcttaatatttctgccttttctctcaaacaaagctgttcccagttcattctcaagtctttttatagtgagacttaaagaaggctgggcaatctttaattgttctgctgctttagaaatatgctcagtataggcaactgtctgaaagtattttagctgcagcaattccatctgtctgcatcctccttatttatttcaataaatatatatataccttattatgtattagattaaatgtaaatgcggatgtaagataatagcatagttaaagaaaaggaaagggtgtcatgcaatgaaaattgatgtgaaagatatagcaaaaaatttaaatacaccgctaacggctcctgcttatcctatcccaaattataaatttgttaaccgtgaatatttaaatattatttaccgaacggatgaaaaagctttgcgtgcggcagtgccggaacctcttgaaattactgaacctttagtgaaattcgaagtgatgcggatgcccgatgtttccggacttggtgcctatacagaggcgggacaagtcgtccctgtcagctttaatggtgaagaaggagattatgtacattctatgtatgtagacaatttcccggctattgcaagcggacgggaacttactgcatatccaaagaaattgggcgcccctaagctgtatatagactctgatactctcgttggcacattagattatggcagtcttcgtgtggcagctgcgactatgggatataaacatttcgaaatggacaaggaaaaagcgaaaagggaaatttgccgacctaattttatggttaagattgctactgattacaatggtgatttaagagtttgtgatttggtgcgcacgcaaataacgaatatagaagttaaaggtgcctggtctggaccggcgcggcttcaattatttgaacatgctctggcgcctcttgcagatttgcctgtattagacgtcgtttcagcatctcatattattacggatttaaccttaaatgcagcacagccggtttataactacttagaggaaaaataaggagacgtttacaatgagaattgcaattttaggagcaggttctttaggaaccatagttggcgcatatctgtctgctggcggaatggatgtcgaattgattgattcatacaaagaacatgtagatactttaaatcaaataggtgctaaagtagttggtacaacggcatttcaggcaaaggtgaaagccattacccctgaaaacaaatcaggcaagtatgatttcatattactactgacgaaacaattatataatgactccattcttaaagagttactgccttttttaaaggatgatagtgtagtatgttccttgcaaaacggtatacctgaacagaaagttgcttcgatcgttggtggtgaacgtgttattgcaggttctgttgaatttggtgctacgtttattgaacccggcgtatccagacttacaactgagtatactcaatttaaagagtacgcttttcaaattggagaattaaatggtgaaacaacagaaagaatccagcgtattaaatcggttttagaccttatcggcggaacacatatttccgataatttagttggaacgaagtggtcaaaattacttatcaataatgcattcagtggtttatcggcagcattaaacggagaatacggtgatattcttgaccatgaaatcggcattgtcagcgcagttcatatcgcagatgagacgattaaggttggacacgccaatggtgtcaaatttgcgaaaatgggcggccttgatttagaatctttggaattaaaaagtgaaaatgagattcctgaacggatccaaacatttagggcagccatggaaccatccaggcttttaagagcaagtatgcttcaggatcttgagaaaaaacgcaaaactgaaattgattatattaatggagttattcccaaaatggcagaaggtactggaatttcaacaccttttaatgatttggttgtagcacaagtcaaatgtgccgaggaatctcaaacagtgcccaattttgatacaaatataaaagcatttgaagagttattacgtatccgaaaggaaatgtgatatataggaaagagtaagggattgctgcggcggtccttttttcttggttcagcaagtaaacaaacgggtgcgttagttacattaaagttcttcgctatggattgaacggcgcctttattgattccgtttcagcaaaaaaagcttccggcacctctctttgatgccgaaagctttttattgtttttttctgtgagcttcattgagctgtttaatgtgctgtatcgcagctttgatgccctctttggcgtccgggtaggattggttccaatgtttgacgagcggcggcatgctttttgcgatatgtgtatacaaaatccactgcctgacttcttcctttacatccgggtttgtttcgccaagcaatagttccgtgtatttctcaagcaggccgtccagctgctgctgcagtttttcttccataccgtttccttccctttttcatgattatgacaatcgggcggtgagggccgcttcctgcacgatacatctgccgcgtccgtgcggaatgcaaagcggcgtgccgaacagcggatcttgcgttacctgacagttcattgcaaagacctgctgtacaagctcgcaagtgatgacttcttcgggacggccctctgcgtaaatctgtttatcctttatggcgaccagataatgggcataacggcatgccagattgagatcgtgcagcaccatgacgattgtgcgtttttctttttcatttaattcaaacagcaaatcaagaatttcaatttgatgcgtcatgtcgagataagtcgtcggctcgtcaagcagaatgatatccgtatcctgagcgagtgtcatcgcaatccatgcacgctggcgctgtccgcctgacaaggaatccacaggacggtcggccatttcctcaagcttcgtcgcttttagcgcttttgtgactgcgtcttcgtcctctttggaccattgcttcagccagctttgataagggtatcttccctgcttcacaagctgatgcaccgtcaggccttcgggagctgacggactctgcggcaaaatagcgagctctcttgccacttccttcgtcggaagcttagcgatggcttttccttctaaaagcacagaaccgcctctcggtttcatcagccgggccaatgaacgtaaaagcgtcgattttccgcagccgttgcttccgatcaatacagtgatttcgccttttggaatcgcgacatccaattcgtcaatgataacagtctctccgtaccctaagctcagcgtctctgtagaaattgcactcataccgctaaccgctccttttttgagtttcccaacactatgtatataaacaaattgcctaaacattcaacgtgagatcatgattatattgtaacagaaattaatgactctgaatatcattatcaattagttttgggcaaaaaagcagcgggcggcggttatttttttatttccgtcatttctccatcgttctttttcagtttcagataaaaatgatcatagcggctgtccaaattaaaagccgaaagcacctgccggacgacctcgctttcctgcatccggccgtttacggcaagttctccgaggatcatcttcatttcgtcaagcgcttcctcgccctctctgtgaacccctgagagcttgtcccggatgtccgccttttcatgaccgctttttctttcatacaaaccttcatagcggttatgctctccggctccgtagctgacgcgcagggaaaagctgctgtaaggaaccggcttctcggatgacacaggtgtgctgtcttgttccgcttcccgtttttcttcattcaatcggcagccggcaatcagcatcagcgtaagacataaaacgcccgccgttctgatccatttcatgcgattcactcccattccattccgatcgtttttaggtatttccaagggaggcggctgtcattcacggaacaaaaaagaaccggagcggtaacagctccggccggttcatctccagattatcattcagtcagctctaaaaattcctgcacatcctgtacggcaaggcggaccgcgtcttcccaaaacgaccgttccgtgagatccgctccaaggtgcttcatcgccaaatcctcaacggtcatcgaagccgtgtcacacaaaagcgcgatatatttttcttcaaaatccgctttttcccgaagagctcttgcatatattccaagcgaaaataaataaccgaacgtgtacggaaaattgtagaacggcactcccgtaagatgaaaatgcagttttgatgcccagaaatgagggtggtattcccctaatgaatcgcaaaatgcttctttctgcgccgcttccatcagttcattcagtttctcagccggaacgacgccctgcttgcgctcttcataaaaacgcgtttcaaataaaaatctcgcatgaatattcataaacatggctacgcttctttgaattttatcttcaagcaagaacaccttttcatcctttgtctccgcttgtttcaaagcggcgtcggcgacgatcatttccgcaaaggtcgaggctgtttcagccacattcatagcgtaggctctgttcagctgccgcacttggagcatggcctcctgatgaaacgcgtgaccgagctcatgcgccagcgtcgatacgttcgaagcgcttccggaaaacgtcataaaaatccgggattctccgctgtcgggaaagctggtgcagaaaccgccgacccgtttgccgctgcggtcttccgcttctatccaccgatcgcggaacgctttttccgtgaatgcggacagctttttgccaaacgtcgaaaattggctgacgatcagattagccgcttcatcatatgtgtattctttcgaagcctcgccgatcggcgcgcccacatcataccagttcagccgctcaagccctaaaagagacgcctttcgattcaggtattcggcaaaaggctttttatgatcggtaatgacctgccacatgacatccagcgtttcttttttcatccgattgatcgcaagcggctcttccaaagcgcttttccagccccgcgctttatagatttccgtgcggaagccggccagatggttcagcgtgctgctgaaaagctcctcttctcctttccaggcttcattaagctctttgaacacttgacgtctgatgcggcgatccgggtgcgccatcatattttccgcttggccgaccgacagctctttatcctcaaacggaatcttcattctgccgacagccgcattatacaggtcgccccatgcgtgatagccgtcaacggccaggccttcaatcagcctttcttctgaagcactgagcttctctctgacccggtctcttctctcatttaaaacatatgtgagatcctgaagttccggtttttgcaggagctcctcccagacccgctcgtcaatccgggcaagtgtatcgtcaagggtgaccagagcggatttaaaatcactgctcagctgattgatccgcgctctccattcattcgctttctgatcatgagtgttctgagcctgaagacagccgacgaacgctcccgcctgcctgatcatgatcgctgaccgttcaaacctatcaatcagattgatcagctcccggctttcatccgcgtgcgtcggaactgtaaatgcttcaaccgcatgttgaaaagcgcttagatgctttttgagctcttgtatgtattgctgaaactcttccgaccggctcccgccctcaaaaatggagtttaaatcccatgtttccttcaatccctctaatgccatcttttctttacccctttctatccgaagctgactccattataaaacaattctgacatatttccgaacgatttctccttctttccgcgagatgttatacactatgagataagaacaaacggggaggattataagatgaacagaaaagttgccattgtaaccggtgcgacgagcggattcgggatgctgacagcgctgaagctcgcccggtcttatcacgtcatcgcaacagccagacagccggagaaagctgtaatactgaaagaggccgccgctcaagcgggtgcatccgcacatattacggtcgtttctttagatgtgacaaatgagcagtcggtgtctgacttcgggaacaccatcagcggtttcggaccgattgagctgcttgtcaataacgccggcactgcgtacggagggtttattgaagatgtgctgatggaacattacagacagcagtatgaaacaaatgtattcggtctgattcacgtcacaaaaaccgtgctgccttatatgcggaaacatggcggggcgaaaatcttcaatatcagcagtatcagcggactgaccggtttcccggctctatctccgtatgtctcttccaagttcgcggttgaagggtttacagagtgtctgcgcctcgagcttctgcctttaggaattgatgccgctttaatagaaccgggctcctataaaacgtctatttgggagacgtctctctccagccatattacggcgcccggcaaagactcgccttattatcgcttttatcagccccttgaagcttacttcaaagccaacgcatccaaaagcggcgatcctgatgacgtagcggagctgatttatcaattggcacaaaggaaacggctgaagaaactgcggtatccgatcggcaggggcgttaagctgacattggctttccgctcactctttccgtggtccgcttgggaatcgattataaagaaaaagctgttcacttaaactaaattataataattataatttagtattgatttttatttgatatgtgatataattaaattaacagatcacagggaggacgatgaatatgaatacacaaaacgcgaaaaaaactgaaactcttgttgagaaatcaatgaacacacaattatcaaactggtttatcctttactctaaactgcaccgcttccattggtatgtaaaagggcctcacttctttacgcttcatgaaaaatttgaagaactgtataacgaagcggcggaaacggcggacgccatcgcagagcgtcttctggccatcggcggacagcctgcggcgactttgcacacttaccttgaacaagcttccattacggatgaaggtcaggaaaaaacggcttctgaaatggtgaaatcactggttcaagactataaacaaatcagccgcgaatcaaaatttgtcatcggcatcgcagaggaacaaaatgacccgtcaactgccgacctgtttgtcggattagttgaagaagcggacaagcatgtgtggatgctgtcagcctacttgggagaatgacgaaaaaagctgaacctcagttgaaggttcagctttttttgcgttcagcttgcgctttcagtttgtttcgttaatgtgacgttcagcgtctttttgcttccgcttctgagcacttgaacagtcgttttatcgccgattttcagctggttatataagatctgtctgatatcggcgctgctgtcgacatctttgccgttcagttgtacaatgacgtcatttgatttgatgcccgctttcgcagccggtgagccggattgcacttcttttacgtaaacacccttagacagctggtcgccgaacagtccgagcgtgttttcctgataggtttccggaacttgcgccatgtcaatcatctgcacacctaaaaacgggcgctcgacttttccttttgcaagcagctggtcgactatcggttctacatcattgctcggaatggcaaagccgagtgactccacgccgttttcactgactttcatgctgttgatcccgatgacctggccgcttgagttgattaacgggccgccgctgtttccggggttaatcgccgcatccgtctgaatcacgttcatttccaccgtgccttgggatgtatcggcgtcaaccgttctgttcagcccgctgatgacaccttgtgtgacggtgccggaaaactgctggccgagcgggttgccgatggcaatcactttatcggcaatgcggagcttggaggaatccccgaagctggccgcttttttgacattggacgagctgatttccaatacagccaagtcactgatggcatcctttccgacaagctttgccgtttcggttttcccattgtaaagagtgaccgacagtttgttcgccccttctacgacatgattgtttgtaatgatgtacgctttttcgccgtcttttttgaagatgacgcctgaccccgtgccgctttccgtttcagagcttgaaccgccgtcaagtccgaactggctgctttgcgaagcttggtagttggacactccgacaatcgcgggctccaactcttctaccatatccgctacgcttgaggtatttttcaaaggcgttgacgtaaaattcgaagactgaacttgtttcgtatcagaaacggcttctgtcttatgctgctcacccggcaggttcggcacaatgccaagcacgaggcctccgccgataatgccgcctaaaatcgggctcagccaagcggctctcctttttttttcttttttcacggcagccgttttttcaaattccgtaccggcagccgtctcgttttccggttctttcgagacgggcccttcaagcagctcgggctcctgatggctgatctgctgctgttcatttctgttttgttccgtatgtgaaagatctgactgatcgcggcttctgccgtcatctcgatgatcgttcatattcacgcacactccttcagcatgttttcattctatcgattacatattcatcgcatgtacaagttctattgtcccaataataaggagaaaagcaaagctccaaaacaaaatgtgtttgaacatgttatcttccccgctttttttcttcctttcttcccttatacacatcataaacaaacattgtgggataaaaatgaaaagaatatgtgaaattatgaaaatgcggcttgagtatgttaaaactagtataatgacgttgaaaggatgtgaaatgccttgtcatacaccatttatctagttgaagatgaggataacctgaatgaactgctcacaaaatatttagagaatgaaggctggaacattacatctttcacaaaaggcgaagatgccagaaagcagatgcagccgtctccccacttgtggattcttgacatcatgcttccggatacggacggctatacattgataaaagaaataaaagaaaaagatcccgatgtgccggtcattttcatttccgcgcgggatgccgatattgacagagtcctcgggttagagcttggaagcaatgattatatcgccaagccttttttgccgagagagcttattatacgggtccagaaactgctcgagctcgtgtataaagaacagcccgccgcaaagaaaaccggcatcaccgtttcttcctacaatgtgatcgaagatgcccgggaggtttatgatgaaaccggcagcctggtcaatttgacgtctaaggaatttgatctgctgcttttatttcttcaccataaaggacaccccttttccagagaagatatcctgctgaaaatatggggccatgattatttcggcactgaccgggtggtcgatgaccttgtgcggaggctgagaaaaaaaatgcccgggttaaaggttgagaccatttacggattcggctacaggatgatgacgtcatgaaaaataagccgcttgcttttcaaatatgggtggtcatctcaggcatcctcttagccatctcgattctgcttctcgtgctgttctcaaatacgctgcgtaattttttcacggatgaaacgtatacgaccattgaaaatgaacagcatgtactgacggagtaccggctgcccggatcgatcgagcggggatattacagcgaggatgcgaccgctccgacgactttccgatccgttcagcacgttcttctgcctgaacgggaggaatcggccagtgacaaagacttgaactatttttcttcttcctttatccataaggtgtacaagctcgcgggccgccagcacagcgtcacgaaacgatacagcgcggacatcagcggtgaaaaagtatttttcgtcattaaaaaaggcctcaccattaacggccaggatgcgatgatgctgtcttacgcccttgattcttatcgtgatgatctggcattcaccctgttcaagcagctgctttttatcattgccggcgtgattttgttaagctggattccggcgatttggcttgccaaatatctctcgcgcccgctcgtttccttagagaagcatgtcaaacggatttccgaacaggactgggatgatccggtcatcgtcgacagaaaagacgaaatcggaaaattaggccataccattgaagacatgcggagcaagctggtgcaaaaggatgaaacggaaagaacgctcctgcaaaatatctctcatgatttaaaaacgcctgtcatggtgataagaggctatactcaatcaataaaggacgggatttttcctaagggggatctggaaaccacaattgatgtcattgaaggcgaagcagaaaaacttgagaagaaaattaaggatttattatatttaacgaagcttgattatttaatgaagcagcgggtgcaccatgagacatttgacattgtgaaggtcacggaagaagtcattgaacggctcaaatgggcccggaaggaattattgtggagcgttgatacagaagatgcattaatgatgcccggtgatccggaacaatggagcaaacttcttgaaaacattctcgaaaatcaaatccgctatgcagaaacggcgattcacattcaaatcagccaaaatcagcagcagattgtcatgacggttgaaaatgacgggcctccgattgaggatgagatgctatccagcttgtacgagccttttaataaagggaagaaaggcgagttcggcataggactcagcatcgtaaaacggattttaaccctgcataaagcatcaatttcaattgaaaatgaccaatcgggtgtaatctaccgaattatcataccaaagtagactgtagtgtttcattgcagtctttttttatgtgaaggaatagccgttaaaatctctgtagtttgctttcagcggtttttggcattgatgaacccatttcttttcacaaattgtctttttcggatatttcaccttttcgactttaattcctctgtttcgcaagcggctgatcatttcatctaattctttcattttcagattcaccctttcgccagaactttgaccattcggtcagctcactttataatataaataaaacaaaacaaaaaaacaagttacaatcaggttaaatttacggaatatcaatatgaccatatagtcatacatgagaagcacaagccagcctcctggctccgaaagggtggaaccattgaaggaaaaagaaaagctgatcattgaagcagcaatcaaactgtttgcccgaaaagggtacaaatctacatcggttcaggaaatcgccgatgaatgcaaaatctcaaaaggcgctttttatctttactttccttccaaagaagcactgctcctatccatgctgaattactactatgataaaacgtttacccgaatcacgacgatccaaacggagggtgacagtccgagagccgcttatcaaaaacagcttgcggtgttttacgaatcgattctcgcccatcaggattttattaccatgcagatgaaagacggttcacttccttataccgaagaagcggcgcagtgcggaaagagaatccgccggtcgatcctgcagtttcatatcgacagtcttcttgctgtttacggagaaaaagctgaaccatacacagccgagctttgttttttaatagaaggaatcagtcagatgtatcttgaatatctcattctgaccggccggtccgtacagccttcgcttttggcaaataccgtgattcacagaattgatgacatcgtaaacggaatggcgggcagacatgatgaagcatttatttctcttgatgaggcaagctcactgtttgggccccttcataacgggcagcccgatcctttaagccaatcgatcttgcagaccctccgcacgcgcatcggcacgatggacaaggcgcaagcatccgaattcaccgagagcttggatattctggaagcggaaatgaagaaaaagtcgccgaaaccggcaatcatcaaaggaatgattttgaatttgaaggaatccgacctgctggctgaagatgcagaacagctcagatttttactgaaacagcagtttatttagaagaacggccgcaatgactgcagccgttctttctttttatgctttcgggtgcaccatatcttccggacgcaccatttcattaaattgttcttctgtcagaaggttcagctgtaatgccgcttctttcagcgtcaggccttctttgtgggcaagcttggcgattttcgcggcgttttcataaccgatgtgcgggttaagcgccgtaacaagcattaatgagttagagagattttcctgaatcgtctcttggttcggctcaataccgacagcgcatttgtcatggaaggaattcattccgtcactgagcagctgcacggtctggaggaagttataaataataaccggtttgaagacattcagctcgaagtttccttggctggccgcaaatccgattgtcgcgtcatttcccatcacttgcgcggcgatcattgtcagcgcctcactttgcgtcgggttgactttgcccggcatgatagagcttcccggctcattttcaggaatgacgatttcgccgattccgcagcgcgggccgctggccagccatctgacatcgttggcaatcttcatcaggtcggcagccaatgcttttaacgcgccgtgaacgtgagtgatttcatcatggcttgtgagcgcgtggaatttgttaggcgaacttttgaatgtctgccccgttacttttgttatttcttccgcgacgtattcaccgaactgcggatgggcgttgattcccgtgccgactgccgtgcctccgatggcaagcgcgcggattttttccgttgactcaagaatcatttctttcgaacggtcaagcatgtatacccagccgctgatttcctgtccgagcgtcagcggagtggcgtcctgcaaatgcgtgcgtccgattttcacaatatcctgataagctttcgctttttcatcaagcgtcgcgcgcagctgatcaagcgccggaacgagctgctcatatacggcaagaaccgccgcaacgtgcatcgccgtcgggaatgtatcgtttgagctttggctgcggttgacgtcgtcattcggatgaatcttcagctcggaatttttttctttcaataaagcagtcgcgcggttggccaccacttcattcatgttcatgttgctttgcgtgccgcttcccgtctgccagacaacgagcggaaagttatcgtcgtatttgccgtttaaaacatcgtcacatacagcggcaatcgcctgtgctttttcagactctaagttgccgaggcgttcgttggcgatcgctgtgcttcttttcaatattgcaaacgccttcacaacacgctgaggcattttttctgaaccgattttgaagttctccttgctgcgctgtgtctgagcgccccaaaatttatctgccggaactttaacttctcccatggtgtctttttcaattctgtagtccatttatgtatccctccataacagttgcttcaccctgagtattattcgccagtaacagatgaaaccctttttatttttcggccttggccgtttttaatttcagctcaagatagacgcgcgaatccttagagtatttatacttcggatttgttttacggtattcttttgacgtgtaagccacttcgtaatgcgcttcaaatgatttgatgagctgttcaatttcttcggcattccctgccagtctgacttgtgccacatctctcctccgctttcataaaaaaacttgtaccattaaatactttatcatagtatatcatttttttaacaggaaaagataacctcaattaaggattggaaggcgggtgactgtcgatggcgcaatcggaattcaaggaatacatacacgttaacctggcactggtgcttccccacgtagagcagaatgatgacctggttcaaaataaaaagatgcttccgaacgggcttgttttttattatatgtatctgagtgaaatgaacgacgaagacaaaataaaagaggcgattgaaacgctgcttcaggaggaagacactctgacgctggatacggtggcgaaacgtcttgataagatcaacgcccgtcccgtctttacgtcgaaggaagccgtcatctccattctgcggggaaaatgcgccgtgtttattaacggacttgacagcgtatacattttgtccacgggaaaaagagaaaaaagaagcgtaaatgaacccacatccgaaaaggtcgtaagaggtccgaaaatcgccttcatagaagattctgatacaaacatcgccatgatcaggcagcgcacgaaccatccgaagctgaaaacgaaaaaggttccgatcggagaaaataagttaaaatacgccacggtcatgtacatagatgataaggcggacccgtctgtcgtcagcgatgttgtaaagcgcctcagcaaagtgaatatggatgacatccaggattccggaacgcttgaggagcttattgaggataataagtattcgccctttccgcaaatacaaaatacggaacggcctgataaagtgtcttccgccttgttcaacggccgcgtcgccatccttgtcgacaactcgccgtttgcgctggtggttccggcttctttaggaattttaatgcagtctcccgatgattattatgaacggtggatttccgcctcgctcatccgggcgctcaggtttacgtctatttttatcacgctgtttttttcgtccatttatatcgccctcgtttcgtttcaccaagggctgcttccgacgtcgcttgcagtcaccatcgcggcgaacagagaaaacgtccccttcccgcctatcattgaagcgatggtaatggaaattacaatcgagctgctgagggaagcgggcttgaggcttcccagcccgctcggccagacgatcggattggtgggcggagtcgtcatcggccaggcggccgttgaagcgaatattgtcagctccatcatggtcatcgtggtcagcattgtcgcgctcgcttcatttacggtgccgcagtacgggatgggtctgtcgttccgtgtgctccgttttatttcgatgtttaccgcggcagctttcgggctgtacggcatgattttatttatgctggcgatctacactcatttatcgagacagcgaagcttcggttctccgtatttctcgccgaatggatttttcagcttaaaaaacgcaaacgactctattctccgtctccctattaaaaatcaaccaaaagaggcgaaaaacgtaaatgagccagaaaacaactcacaataagcttacaagctatcaagggacagcattgattgcaaacacgatgctcggcgcggggctcctcaccatgccgcgggcgctgtcatccagggcaaattcgccggacggctggatcgcgttatgtctggaaggcgtcatctttatctttttgatttatctcaatacgctcattatgaaaaagcatcagtacggatcattatttgattatatgaatgaaggactcggcaaatgggcgggaaatattgtcaatctgatgatctgtctctattttataggagtcgccagcttcgaagcccgggcgatggcggaaatggtcaagttctttttattggaaagaacgcccgtgccggtcacactgtttatctttatcgcctgttccgtttatttaattatcggcggcatgagcgatatcggcaggctctttcctttctatttaacgattacgatcattattttgctggtggtgttttctttcagctttaaaatatttgatctggacaacctgcggccggtgctcgggcagggattttctcccgttatggcttccttgaccgtcgtttctgtttccttcttgggaattgagattatgctgtttctccccgagtacctcaaaaataaaaaacacacattccgcatgtcggccataggctttggcatcccgattattttatacatcattacctacgttctcgtcgtcggcgccttaaccacccaggatgtcaaaacaatgatctggccaacgatcgcgctctttcaatcatttgaaatcaaagggctttttattgaaaggttcgagtcctttttgcttgttgtctggatcatccagtttttcgccacctatgtatcatacggatatttcgcgacatcagctcttcataagattttcgggctgaaacagaaaaaaggcatcatcttcgtaggcatcgcgacattcttcggatcattgttgccaaaagacggaaacaagctgatgctgttcagtgatattctcggctatatcttcttggttttctttttgctgcctttactgatgtttgcagtcgtcgctgtgaaaaggaaggtgaaaaaagcgcaatgaagaaatacatcgtaatcatattttgcacattgcttttggccgggtgctgggacagccgcaatttagaagatttgagcctcgttatcggagtcgggctcgataaacccgcggaagaaaatgtggaagtgacacagcagattctggttccgcaaaaagcaagtgcccagcagtcgtcgtcaggcgacacgacaaaggtgacttccactccgggggaaaccgtccatcaagcattaagaacggcatcgttaaaaaatcacccggccttctcccagcacttgcgtatcatgctgttttccgaagcgctgttaaaggatgacattccgcttgacgcattgatgaaccaatttatcagagacaacggtacgagaagaagctgcaatgtgatgacggtgccggataaaacgaaagatattttcaatatcagtgaccagggagaacctgcgtcaaatacgatctatgacttaacggagaataattcggtcaccatccggatgatggagcccgtgacattgggggaaatatcagagaaaatcgccaagggcgaaacctttgcccttcctcaagtgcgcaaagtgggcagcagactggaaatctggggcgctaccattattaaaaataaattctggtatgcgaatttaacgcctttacaagtccagaatatgaacctgttcacaggcacggtaaagggaggcgtcacgtttgcaaagcatgacaattattatttatctttcgaggtattttccagcaaatataatgtaaaaacacaatataaaaacggaaaattcaagtttatcgtcacccggtttgttgaaggccgtctgtctgaggattggaatccgaaagaagattctttcaaggagtcctatataaatgaaatcaaaaacgcggtaaaacgcagcattcattcagatgttatggcattcattgattacatgcagcatgagttgaaagtggatattaccgggttaggcgatcaagtccggattcattatcctgataaatggaaaaagatatcctctgactgggatcatcacttcagtgaatcggatattgaatacaaagtcaaagtcgccatcagggatttcggaacaaagggaatgtcccaatgaccccgtccctcgggagagtgtgccggcgccgctctcctttttttatgtcacgagatgattgcggtgggcatatacggctgcctgcgtgcggtcactgacatcaagctttgacaatatattcgtaatgtgggttttcaccgttttaatcgtaatgaacaactcttcaccaatctctttattcgtcttgccttccgcgacgagacagaggatttccagttctcttttcgtcagcgtttcatgcggaagctgattctctgaatggcgcagccttgacagcacttttcccgccactttcgactcaagcttcggttcacccttggcagccgctctgatggcttctgctatttctgccgccttggacgttttcagcaaatagctgagcgctcccgcttcgatcaccggatacactttgtcgtcatcaataaagctcgtcagcacgatgattttcgggtcattgagtttcgcgcagatctgttttgtcgcttcgatgccgtccatgccgtccatgacaaggtccattaaaatcacatccggcaaaagctctgcggccagatcgacgccctgctgcccgtctgatgcttcaccggcgacttcaatgtccggctgtgcttctaaaaatgcggccagacccatcctgaccatctcatgatcatcaatcagtaacactcgaatcactgtcgttctctccttttgttttctgataaatcgggactttcacgtcgatctgcgtgccttttcccttcacggagataatttccgctatgccgccgatttcactcgctctttccttgatggaatgcagcccgtatgaggatgctttcacttgatccatcgtaaaacccgccccgttatcaatgactttaagctgcagcttttgatgtttcgcgccgagtctgacggtgaccttggtcgcctttgaatgtctgaaaacgttggaaagcgcctcctgcacgatgcggaacagatggtcttcaacaccttttgacacacccgtatcgctgatgtcccactcaatatccagcggctgcttcgctttgaactcttttaacagctcaatcagcccttcttttaagccttttccttctaaagtgacgggccgcagatgcaatagcagcgctctcatctcgttttgcgcttcccccgccatatgttcaaccatgcgaatccgtttgacgattttgtcatccgcatctttcacctgctctaagacggcggatgtcatcatagaaatggcaaagagctgctggctgacggcatcgtgcaaatcgcgcgccagccgctggcgttcttcagtgatgaccgattttttcatttgatcctgccattccgcccgctcgttggagagcttttgcagcgatgtgacctggagctcgacccgcttggccatttcgttaagctgatctgccgccaggccgatttcatcatcgccgagcggcggcacccgataagcgaaattgccgttttcaaatttcaaaaccgcttcaatcagtgtatccattcttgttttcaggcggccgccgtatacataaccggaaatcaatccggccgaaagagacgccagaagcaggatgaccacaaacggaataccgaaccagccggaagaaaacagcagcatcgggtcaagcccgtaatacagcagcatcagcgtaataaacaccgcacaaaggagcagactgagccccgcagtcatccgcatggcgcgccactgaatattggcgagtaattttttcctcataaatacttcacatccacatcgccgatgaataaagaaattgaaattttaatccgccgcggcgagtcgccgtactcagacgatactttataaagattcgggctcatgccgcttttcttagatccgagcaggttcatatcgccgataaaagccgatgaactgacggacacttcgatatccggcgggacgtacacatcgacattgccgatgacaccgctgatggtcatcgtgctttctccttcgggaatcatcgcttttgacaaatcaattttcacatcgccgatgaatccggaaacatttaaatcattcagctcaaacgggtccttcatcatccggagctcgccgataaaaaagctgcggaggtccggctgtctgctttccgtctggacggaaggctttggctgctcttctttttcaagattgattttcttctctttatgttcatacacgcgctttcctttcaggagcctgtagcccgcgtatatgagaaaggcggcgaaggcatagccgaacaggttaaaggtggcgctgaacaggttcctcaaaaataaaaaagcggcgaagatatacaggacggagccgagccagccgcgggaatatttattaaaaatatagcctgtgatcagaaaaaagagcggccaaaacaagaagtcgccgatgccgataatacgcaaaaacatgctgacgcctaataaggcgatgataagtccgagaatctgtttttttgccatcagctgcctgcccctcctttccttgactattgcagtgcaatattgccgctcgtcacttttatatcaatcggcctggcgccgctgcccttcataccggtgaatgccccgccgtccttactcgttttctcaaaggaataagacggctgaatccttccgcttgccgtctcggcgttcaccgtaaaacttccgtctttcggcaggctgatcgctgcgctgccgctcgcaagcctgacggatacgggagcatccgccgtctcaagcgaggcgtcgacactgccggaagcgacccgcacgtcaagggcgcccgccgcatgttgaagcccgacatgtccggaggataagcggatatcccccgttttcgccgcaaggcctgatgctgtgaggttgcccgacagccccttcgcttcaaacacatccgtcttcacgtgcttcagcgacatattcccgcttacagaacggacgccgaggtgcgcaagagacagccccttgtttccgtcaacggcaatggtgccgcttgacgtatggacggtaatgtcccgatgataatcatacggaatgcggacaatcagcagaggacgctgaaagagattcagaaattggaaccctttctccttcgctttgagattgagggtttttcccctgctttggacaaacattttccccgccggtcccgccatgtttgccgcgatatcattccgcgcttccgcgatgatttttacatccgtctgttccgatgaaaccgacaggctgttgacggcacgcggcggtatgcttgccgattccgcttctgtttcgtacagcggaaaaaaacgcccggcaaacacttctttcaccaaaaacagacagcagatcaaaacggacgccgccatcagtcctttggccatcttacgcttcattacgttccatcctttttcattcattttattataaaggaaaagccggagaattgatacgtgcgtatagggaagaggcgtaaaagcgccgatcttcccttgtgcacattattcatgagccgctttttgatgctctgttttctccagagaaagcgagcgcattttttcaatctcagcttccacctcgtctgaatattgggagcggctgtattctgtgttcgcctcagctgaagtgccgtatttgacgcggacttccatttcttcaatgcggctttccattcgaagaaactctctgtaggcgctttcactgtcaattttgtcgaaagaagcgttcatatgttccttcgcttttgccgcgttggcgcgggcgatgagcgcctgttttttatcctttacgtcgcggaggcgcgtttctaaagtttccagctgctctttcagctctgccagctgtgttttcgcctgctcatacgctttttcatgttcggccgcttttccctcaaggtatttcatttcagtcagcgcctttttcgcaagctcctcttccccggcgtcaaaagcaagctgagcctggtttttccgttttgccgccgtttcggaggcgtcttcctgttttttcttaaactgatggacgatcgtgtgctgtttgacaatcgtttgtttcgccttagcgatgtcactttccatatcacgcacatattgattcagcatgactttcggattttctaatttatcaagcccttcgttaacagatgcgacgaacatatttcttattctttttaagaccattttgtcttcctccttattttttcttcagaaattcttcccattcagagtcaaatccggattgatagcccggtgatgccgcttccggttcatactggcgggaagcggtgtctgagccgccctgcttcatcatcttccacccgaaatacaccatggcgccagccagtccgatggcaacgataaatggaagagaaccgacgagaatcatagctccgatgaagcccgcgatgatacccgataccgcccggccttttgaaaaacgtttgattccccagtaaagcatcaggcctccgatcgccagcgggatgataaatgcgaaatggcctcctccgaaaaagacagaaagtccgaacacaatcagcagaaagccgcctgccgtttttacatttatattcatgcagatcctcctttcgttttccttgtctttactataaacaaatcccgcggccggcaaaacgagtcagagattgattttcatatcagaccggagtcgtataaccccccggaccttcgcataaaaaaacgccgctgcaccggacggcgcagggcgtttcacgaaaaatctatattctgatgctcgcttctttttccctgatgagatctgagcgttcagctttggccagcttcgtaaagagcaatattccgagaccggacaggacttcaacgagaccgccggcggcaatgacttttccgggaccgaaggcgttagccgcgtatccgcaaagaaccgcgccgagcggaatggatatgtttgagatcatatggatgacggcatagacttgcggctgatcatcatggtccacagacgtctgaataatcgtatattccggcacattaatcgcgctgacggcagatccgaacgcaaacgcggcgaggaagacgagcggcagaaaagtgttgaggccggtgatgaaaaatgccgccccttctatgattcccgctgacacaaacaggagaccgtatttgttcaccttcaccttagccaaaataaaacccattaaaaaggctccgcccgtgcctgtcgctttcaaaagcgagtagatgatcggcggcatgtttaaatcttcggcgacataaacggcagagagcgcctcccacggagcggccgcaaaattcatgaagatacaatagatggcgagcgggtataaaatctggtgtttcctgacaagaacgaaaccccgtttgagccttccgacatacgtcccgcgctgtctgacggcgacggtatcctctttggcatgctggacttggtatgacataaagagtacgagaaaacctgatagaagatagaatataagagcgataaacaaagaataagcgggactgataaatgttaagaacaccccgctcagcgtaatggcggcaagtctgacgatctggcctgatgactggatgaccgcattcgctttctgcaggctgttttctccgacaatattggggattaatgagatagatgcaggattataagcggctcccgtggctgaatgcaaaatcatgagaagcatgacaaaccataaaggagaaaaaccgttaaagtaacagaccggaatgatcaacacgaccgccgcgcgcgtgagatcggagaaatacatccagaacttcagcgtatgctgcttcataaaaggcccggtaatcggcgccagcatcgcctccggaaggaacgtgaccgcaatgagcagggacgtaccgatcgcgccttccccgtcaaaaatcaaaaaccacagaatggaattaaaggcaaaaccgtcgcccgacaatttaacaagcctcgagataaacagaagggtgaaatttttattccagatgctctcgctcttattatatgtatccatctatcaaatcccccattattttacaatgtttcttataatatctcattttttaatttttcagtcaataatgcataagatacattttccttctgtcaataaaggttcaattgatggatatttctataaaaaaacagccggcttgctgctgccggctgaacaaaacgttattcatcatcacggaataccgcggcgcttctttcatactctatatcctgaacgcactgtcttgcgttaactgctcttgccgccgcgaaaaaataatcagacaggcggttcaagtaacgcatcaccgtatcgtttatctcttctgttttgcccagtttcacgacgagacgctcagcccgtcttgtgacggtccgcgcgatatgaagctgagcagccgccttatgcccgcccggaagaataaatttctcaagcgggggcgcttcagccgtgtaacggtctatgcagtcttccaatgcggaaatagatgtctctcttaatgtatagcttctatgttcagtgaccgtcgccaagtcgccgccgcagtcaaacagctcatgctgaatgtttcggagttcggctttcacatcaccgcaattctcacaatcggctagctccgcaagcgcaagcccgataaagctgttcagctcatcgatcgtcccgtagctttcaacccgcagactgtctttatccgttctgccgccgatcaggcttgtctgtcctttatcgccggttttcgtatacagcttcattgttgtattcctccttcttccgccgcttttacacataccgcggttcctcttctgacggctctttccgcgtgagggacgtccattgcctctcctgtctgcaaggcacaaatggcaatgtcgccttttgcctgtctgccggaaagagcctgcattctcgcttcagccgctgccgttaacagccgaacaaatccctgttccgataaacgtccgctgatcagcacccaaacggtatactgcgcagtcacggctatcgtaaccgaatcaaacgtacggcagatcaaaccagctgccgccgagccggaaagccggcggctccacgaaaagcccgggccgtcagatgcggttgacagcattctaaacggccgttctgtatgaagcgttacggtatttccgcttttgtttatcagagaggcgaacggaacgccggcgggctctctttcctcccgcgcttccggcatgaaagcgatcagcggtttcggcgacgattgccgggcaacagcgctgacggtaatgccgtaaatgtcttcaatcgtctcttttttcaaagcctgatccggtggctgcttcggaaaagcgcgtccgtctttcatcatcaggagctgatcacaatattggcttgcgacgttgaggtcgtgaaaaatactgatgaccgtcaggcctctttctctcgtcagccgcttcaccgtatcaagcaggtctttttgatatttgagatcaagaaaggtcgtcggctcatccagacacagcacctcaggctgctgagccagcgcctgcgccagatagacgcgctgccgctcccctccgctcagattgcggacggattgctgtgcatatcggtcgatgcccgtcatttccattgcttcccggacaatgtcttcgtcatgttgatccatctgtctgaagagtcctttttgatacgggtatctgccgaaggacaccgtttccttaacggtaaatgtaaaagcttgctccgtatgctgcggcaaaacggccataattttcgcaagctcccgcggcttgtatctgcccgcgggcctgcctgcgacgagcacctcgccctttgacggagagagcattcccgtcagcaatttcatcagcgttgtttttcccgagccgttcggaccgagtatgccgacaaattcaccttttccggcggtaaaactgacatcttctacaatcatccggcctccgtacccgccggacaggctgctcaccctgatcataagcgtttccctccatgatgctggcgaagcagaatcaaggcaaacacaggcgctcccgccaaagccgtcataatgccgatcggcaattcgacaggctcaataacggtgcgggaaaacaaatccgccaaaatgagaaacccggcgcccgtcaatgctgacagcggcagtaaatggcgatgatccgtcccccacaaaagccgtgtcacgtggggaatgacaaggccgacaaacccgatcgtccccgagacggcaaccgctcctcccgtcaacagagatccggcggcgatcatcagcagttttctttttcccgtactgacgcctaacagctttgccttttcttctccataagtcataatgtttaattctctgccattgataagcagaagcgccgtcccggccagaaaaaaaggcagaaacagcgcgacatagccccagcccctcattgacacgcttcccaacagccagcggacaatcgggagcagatcatttcccgttaaagcaatcacaagcgaaatgagagccccgagaaaagaattcataatgatgcctgtcaaaatgagcgtcgaaaccgacatcgacgcatgaacgaggcggctgaaaaacagaaccgccgccataaccgcaatggcagcggcgatgctgacaaccggaagtgtgaaccggccgatgacgggaatctgaatgccgaaaaacaaggtgataacggctcccgccgaggctcccgaagataccccgagtgtataagggtcggcgagcggatttttcagaagtccctgaaacgccgcccccgcaatggatagcgcggctccgacaagagcggccagaacgactctcggcaggcggatattgatcataatatttacattcatgggatcaacagaggatgtccggccgatcccgatccaaaaaacgtcggataaaggaatatgcagactgccgattgaaatgccgagtgccgtacaaacggctaaaaacagcaggctgaccgtgtaggccagcgggcggttactttttaaacgtttcaggataaacgctttctgcaagcttctcgacccctttgacaaggcgcgggcctgagcgtgtgacaaggtcaggatcaacagaatagacattgtggtgtttgaccgcattgacggcaccccagccggcgcgtttttccacttcagcggcctttacgccgtctgtcgtgatgataacgtccggattcattttgacaatcgcttcatccgtcagctgcacccagccggtctggctgccggcggcgtttttcgcatgtatatcttcaagcatttcgttcataaacgtgtctttccccgtcgtgtagccgtcaggagacacttcgacgaatactttcttttcgtctttttcagaaatggccgccgctttcttttctatgccggaaaggtcggatttcatcgattggatcagctgatccgcctgcttttctttgccggccgcttttccgatcatgctgattgatttgtacacatcttggaacgattgcgcatcattgaccgttaagacggtgatgcccgcatctttcagctgcttcatcgcatcggcggaagcggacatagaggacgcgtgggcaagcacgagatccggcttcagcgcgatgactttttcagcgttcacattcatatctccgactttcggtttttttacggcttctttcggatatgtatcatttgtcgtgacgcctgcgaccttatctcccagtccgagcgcgtatgtaatttccgtattgctcggcatgagggaaacgattttttccggtgcctgctttatggttactttttcgttcgcggcatccttaatggttaccgggaatgcttcggttgtgacggctttttgtttggccgcgcttccttcttcctgtgcgccggaacagccggcgatcacaaaggcggtgaccaagagcgccgcccagacggcagtgatcttcttcattcttttaactccccctgattatggtaaacgattgtctctttgacattcgtatccttttttcgcagtaattatactataagtctttaaggcttgtatatccggcctttttgcatgaaagcaaattgttcgtacacactaaaattcatcatgtatactgttacacaatggtgtaataaggaggattatcatggaattacagcttgaacgaaagctcgtgttgattacaggatcaacttcagggatcggaaaagccgcggcaaaaagctttttagccgaaggcgccgaggtgattgtaaacggaagaaaaaaagaaaccgtggaacggacggttgaggagctttccgcttacggaacggttcacggcatcgctgcggatttatcgcgtcaggatgaggcggatgacctgatcaagcgcgccggcggaatcggggaagtcgatattctcgtcaataatctcggtttttttgaagtaaaggacttcgctgaggtgtctgatgacgaatggactcggtattttgaagtgaatgttatgagcgccgtgcgcctgtgccggcgttttctgccgcaaatgcttgaaagaaacagcggacggattttgaacatctccagtgaagccggagtcaaaccgcttgcgcaaatgattccgtattcaatgacgaaaacggcgttaatcagcttgtcccggggaatggcggaaatgacgaaaggcacgaatgtcacggtcaactccgtgctgccgggaccgacatggaccgaaggcgtcgcttcttacatggaaggagccgcaaaggctgccggagaagacacggacagcttcgtccgggattattttaaagtgaatgaaccgacatctttgattcagcgctatgcaaccccggaagaagtcgccaatacgattgtatttctcgcttcatcagctgcttctgccattaacggcaccgcacagcgggttgaaggcggcatcatccgctccatttaacacaaaaaagcccggcacaaggggaacttccccatatgccagggcttttttttacatcatgcctgcaaacggaaccggctcccagccgcccgtctcaagctctgctgaaaacaggccgcccgcatgcggctgctcaagtctttcggcttccgtcaatttttccgtcgcggtcgtaatgtataacgtgttcaaattgctgcctccgaacgcgcagcaggtgacgtatttcgccggaacttcgatagatgcaatttccttatgcaaaaacgggtcaatccggacggcgcggccgcctccgaacagagccacccacagcattccgtcacggtcaatggtcattccgtcgggagatccttgcgactccggaaagcggtagaccgttttcggatctgatacggctccggtttcaggatcatatgcataacagacgatttcctgcgtcggagtatcaatatagtacatcaggtttcggtcccgatcccaatccaaaccgttcgaggtggagacctggtcttttattttggcaaggctgccgtccgtattcagacggtacagcgaagcctcctcttctttgccttccatgctcgtcgttcccgcccataatctgccggacgggtcgcattttgcgtcattgaaacggatatcttcccgcatgtctttcggctgcttcatcttcgtcaatgtgtcttcccgcagattgtacaggtaaaacccgtctttcatcgtcatcaccagctcttcctttgaatacaaggccagagccgtgacaaatgatttgaatttaacggaacggttgattccgtcagccggagtgaagatatggagctggctgcccagtatatccacccagtacaggcattccttatccttgtcccataaagggccttctccgataactgctctcgtatctgctcgtaatgctgcttccatatgtgaacacctcttttgcttgtcagtcttctattgttattcccgacaaagcggcgtccaaactcaatcttttttaaaaagaatcgtaatcaccgttccggcgctgattctgctgttgacatggatggttccgttatgaaggtgaaccagctctttggcaatggcgagcccgagtcccgttccttctgacggccccttcgtattcgttccccggtaataacggttaaacagctggtgaatcgtttcatcgtccattcctcttccgttatctttcaccttcagaatgagctgttcggctgattcctcaagcacgacccgaatggcggtccccttcttattatgcttaaccgcgtttgccagcagattctccagaatacggcggaaccacgcttcatcaatggcgaaaagaatgtcttcctttttggtttcaaaggcgatgtcatagccttccgagaacgtgtttttcgtaaaatcgttcgtgacgtttctgataaacggcacgacgttgatcagccgccgttcgatcgggagagccgcgtttttgaggcggtatgttaagtttaagtcctcaatcagcttcgacatatattctgatttttcccggacgatctgccccatttctttgacttcttccggtgtccagtcgtattgcttcgattcaagcatcatgctgtagccgtaaatcgtgctcagcggagtttttaagtcatggctcagcccggcgatccattcttcccttgtcgcctggattttttctctgtttttcttatcccgcttcagcgtgtcggtcagctgatccatcgattcgaaaatctcggcgaaaaagcggaacggctgttttgttttgccttttttgtttttgctgaccggctgtcctttgcggttcttcggctcttcaagccggccctttgataaattgacaagccatttgatggtatgaaacagcggccagccgaaacggaaagagtaccagatggtcaggatgcagatcataaatactaagattccgatcaagaggaagagggttttcatcacatttctcaaaaatgatttgttaaactcgtgatcggggatgtacacggggttcggcaccgacgcgaccatccatttcgttttatcgagtcttttaaaagaaatttcccgtttgtaattccacggcttggaactgtatttcagcaattcaagctcattgacggtgttccgttcttttttcgtgctgttgatatccccgagcagtctgccgctgttttcgagaaggtagaccgcccctttttcccgtttaatataatcaaccgtgctttttttatattgagaaagggaagcgagggatggctcctgtgattcgatgtaagtgagaagctgctcactggcggatttccagccgaacagaatcaaataggtctcatcatttatcgtgaccgtccagtaattcagcttgtagttgtcaaaattccggtactggtaaatggataagaggtcttttctgctgtaatggctcgggacgtctttcggcactctgtatgcgtagtccgttttttctttgtcattaatgatctgcagccagcccttctgctttctgaccgacatctttaaaaattcatcgacatcccatgtgccgtcttcgtttttatcaagccacgcttcaaacgagtctgccgtcgctttggtcagtcccgcattggcttccgcttcgctgaaacgccaatccaaatagaagaaagaagcgacggccaaaacggacatcagcaggatgacaagcagaagctgtccgaaaaagtggagcagaaattttccgcgcattctcatgagcgggttcctttttctccttgatcgggaataaaccgatagccgaggccgcgcaccgttacaatataagacggattgctggggtctttttcaatcttttctctgagcttgcggatatgcaccatgacggtgttgttatcgccgtaagacggatatccccacactttttcatagatctgatcttttgagagcaccacatcagggtgttcacagaaatattgaagcaattgcagaagctgtgcggagcagctgacgggctcgcccccgacgatcagctcggcgttttgcggcgaataggaaaaatgactgtatgaatacgtttttaccgccgttttctcttcgcgcttataggttctctttaacgtcgctctgatccgcgccgccaattcgagcggattaaacggctttgttatataatcgtcagctcccaatgcaaatcctgacagcttatccgcatcagaagaacgggcagtcagaaaaaagatcggagcgtcggtataattccggatttcggtgcatgcttcaaaaccggacatgccttccatcatcacatccagcacgagcagatccgcagtttcatgtttaacaaactcaatcgcttcctcagcgcttccggctgtcttaatgttgtgatagccttctttgacgagaacgcgtttgaccatatcaacgatcgccttctcatcgtctacaattaaaattgacgcattttccaccttggacgttcctttctctttgtttttttcatcatatcattatatggataagatttggtacctttttagtgcggaggtcttgcgggggaacagaaaagaaaaacgagacggacatctcttctcgtttttctcacgttgtcagagcggaatatccatcattccgccgcttttgtcaggagctttcatttataagatgaagaataaattcccaaaaacccggcacttcctggcataacagcatgtccgctttttcaactattttaatcttcaattcttgttcaaggtcttctctttcctggtatgatgtattgctcagttttttttttatcattggcgaaaaacgtgaaatcaaaagttccatttcgtcggtatctgtgttctctttgttgaagtcaaatggcccgttcactgcttattttccccctttttttgcttgtccagctgctttctgagattgtcgagcccttttttatgaatattggaaatgttctgccgtgattcacccagcgactcggcaatctctttcatcgtcgctccgtgaagataaatattcgtcagcacgcttttttgtttatcggttaacgtctgaagcgcttcgtataaatcacggttttggacatgctggctcaaatctccctgcttccgcagaaactcttcatacgcgtcttttcccatttcatagggaagcgcttcacctccctccggctgatccaccgtcagcggatagcgattctgatttttacggatgcgcttgtcaaaatcgatggagaaaatccggatcatagagttcatatatttgatgatccggatttccttataaaactgtttaaaatggtcgtccaatgattttgcatccttctcgtctgaatgttccagcacatttttaaatttctcgtaatgctttgggtcacttaaaaaatgtttaacgatcggatgtttcataatttccttgcattttgaccgtaaaagaacttgatagtccataaaaccgccccctatttaaattaaatgaaagaaagcaaaaaaaagtaaactactcctttccgactaagattccgcattccttatgtcccggatttgccggaacaaaaaaaaagaccctcaaccgggatatcaggtttacaggagccgctctttctttcacttatatacatgactgcaggtcaagtcaggaggtggctgacaatggatcaggtttttatagaagaagcggtcagacagatcggcaatctcggctttccggctctgattgccatgtatcttctcacacggtttgagaagaagtttgacgccctgatcgaactgatgacggaactgaaagatcagaaaatgaaaaattaattttcacacgaagttgacttttcatcggaacgcatcacttaacaaagcagaagggaaaacgaaaggcctttcacattctctttctgaaaaaacaaagcttgagaggagacgatttacatgtcaaaagaaaacaactgcaatatcccgcagccgatcagaggagacaaaggagcgaccgtcacgattccgcgcaacctcgaaagagaccgccaaaatccggatatgctgacgccgccggaaacggatcacggcacagtggataatatgaaattctctttctcagatgtgcataaccggctggaaaagggcgggtacgcgcgtgaggtaaccgttcgcgagctgccgatttctgaaaatctggcatctgtcaacatgcgtttaaaaccgggcgccatccgtgaactgcactggcataaagaagccgaatgggcatatatgctgacgggcaaagcgcgggtcacgatcgttgatgaacagggacgcagttttatcgatgacgtgaaggaaggagatctgtggtacttcccgtcaggcctgccgcactccattcaggcgctgaaagaaggctgtgaattcctcttggtttttgatgacggttccttctcagaaaacagcacattccaagtgactgactggcttgcccacacgccgcttgatgtcatcgccaacaatttcggggtttcagaaaaagacctcgccggcctgcctcggaaagaaaaatacatctttgaagagccggttcccgggaagctgaaagacgacattgtggaaggcccgaacggcgaagtgccttatccgttcacttaccgcctgctcgatgaaggtccgactgctgagacggacggcggcaaagtatatatcgcggattccacaaacttcaaagtgtccaaaacgatcgcttcagcgcttgtcgtggtcgaaccgggcgcaatgagagagctgcactggcatccgaatacgcatgaatggcagtattatatttccggtaaagggcggatgacggtttttgcatcggacggccatgcaagaacatttaactatcaggccggggatgtcggttacgtcccgttcgcaatgggccactatgtggagaatttgggggatgagccgctcgtcttcctggaaatcttcaaggatgaccactatgccgatgtgtccctgaaccaatggcttgccatgcttcctgagaaattcgtccagcagcatctggatctgggcaaagactttacggatattctttcgaaagagaaacaccctgtcgtcaaaaagaaatgctgaagatacacaccgacttgcagagttccgtctctgcaagtctcctctgtgtgaaaaggagctgaacagatgatcaatcaaaacgggacgaaaatgttttttcttcaggtgctccggtatgccctggcagccgctgctgtattattcgggtatttcatcgtgatgatggccgtattttcattagccgggacgagctacggatcgatggcgtacgtcctgcttttttccgtgctttttattcttctcggtttatgttttgaaccgcttgaacggctgatgatacatagctttaccttttttgggacgggcaggctgccttttctccttttagccggcaccgttcagctgctgttcctctggatgactgcgtatacgacggataaactgattgaaaagatttggctgtcaacgacggaggagctgattgtggcgggggtttttttcgttttggataaatgcgtctccggacaaaagcagccccgggcgcactaaaaaacgcaggccggaatggctctgcgttttttcatcttaccgttgcgttttcatgccggattaaatcgtaggttaagcagaccggtttgttcgtgcgcggatcttttacaatctgtgcgtcaatttgaaacacgtcttccaatataccgggagtcatgacttcctccgccgttccttccttgatgacgcgcccttttttcagggcgatcatgtaatgggaaaaacgggcggcatggttcagatcatgaatgaccattaaaatggtgcggccctgctccttgtttaatttgtccagcagctgcaaaatttcaagctgatgggcgagatctaaataagtggtcggttcatcaagaagcagcagctccgtttcttgagcgagcgccatggcgatccacacacgctgccgctgccccccggaaagcgcttcgatcggccggtcgtaaaattcggccatccccgtctcttcaagcgcccatttgatcatgtcacggtctttatcactcaagcggcccattccggactgatgcggaaacctgccgtaagaaacaagttcgtacaccgtcagcccgctcggcgcttcaggcgtctgcggaagaattgccatttccttggcgatgtccttcgtggatttttgcatgatcgcctgtccgtttaaatagacggcgccggatttcggtttcatgattcttgacatcgttttgagaaccgtcgattttccgcagccgttcggaccgatcagcgttgtaatttttcctttcgggatggcgatatccaattctttcgctatcaaacggtcgccataaccgacagtaagctgttccgccgataatgagttcatcgcggcagtctccttcctctatttcgttttcatcagcaaatatacaaaatacggcgctccgagcacggaaatcaccaggccgacgggaacttcggacggtgcaagcacatttctcgccagcgtatcggcaagcagaaataaaaatgctccgatcaaagctgaaaccgggataagcgtctggtggcgcggcccggtaagccttctggccaaatgcggcgcaatgagtccgagaaaagcgattccgccggctgccgcaacacatgacgcggtcagggcaacggcggacatcagcagaacgcgccgctccttttcaaccttggtgccaagccccgccgccagctgatcaccgagctggagcacatttaaatacctggctttatagaggctgaacggtaaaagaaccagcagccacggcaaaatggacagcaccattttccaattggcgttccaaatcgaaccggaaatccatacaagcgcctgcatgaaatcccgcgggtccattttcagctgaaaaatcaagagaagcgcattaaaccccgcattgacgccgatcccgaccaaaacgagccggacaggtgaaacgccttttttccaagccagcacatagatgagcagcgcagccagaaaagcccccgccaaagcgctcaccggaagcagccatgtactggccatgcttagatcaacagctgacccttggaaaaagaagataaacagaacgaccgccaaagacgccccggcgttaataccgagaatgcccggctccgccaagtcattttgagacacgctttgaaaaatcgcgcctgaaaccgcgattcctgcgccgacaagcaatgacagcaccatgcgcggcagtctgaattcaaataaaacgagctgatcccgggcatccccctgtccgaaaaagacacgcatcgtatcaagtggcgcaatccggatcacacccatgtttaagctgataaaaaagacgatgcatatgagcacaaacgtaacggccatgaccgccagcggttttttcgattttacattcattacagccctctcctttccctgcgcgccaaataaaagaaaaagggaacgccgataagggcggttaaagcgccgaccggtgtttcaaacggcgcattgacgagtcttgcggcaatatcactgaagactaacagaacggcgccgaataccgccgaacagggaatgatccacctgtaatctaccccgactaaaaatcgggtgatatgcggaatcaccaagccgataaaagaaatggctccggcgactgagactgaagcccccgtcaagaggacaacgacaaacattccgattactttcacaagcgatgtgtactgcccgagccctttggccagttcctcacccaagctcagcaccgtcactgagcgcgcaatcagaaatgccagcaatagtccgataacaccggccgccaacagcagctgcacgccttcccatttcacagaagcaactcctccggcataccagaacttcacatcctgggcgacatcaaaacgtatcgcaatcgcgcttgaaagccccgttaagaaatagccgactgccgtaccggccagcgcgagcttcaccggtgtcagcccgccttttgaaaacaggccgatgccaaacacaataagcgctccgattcccgctcccgcaaaggaccacaaaacaagtcccgccgcagacagacccggaaaaaaagcaaatgccaatgcgatcgcaaatcctgaccccgacgtcacgcccataatggaaggctcagcaagcgggttccgcgtcagcccctgcataatcgctccggacacagctaaaaaagccccgacgagcgcggcggcggcggttctcggcagcctcagatcgcgtatgatttgatgagatgtattttgcggctgaaagtgaaagagagcatcccacaccgtccgcagatgaatatcggcagctccgatggaaacagacagagcggcgccgatcaataaaaccgcaataccggcacacagcagcacagccgctctgaatgaacgcgccgtccactggatttcactccctgatgccccttgagccgtcattgtctgtttctttttcaatagacccaacactcgttcttcctttctcaaaacaagaatggtaatgataatgattatcaatgacttgtttcagtatagcacttttatcttctcttttaatagacctaatttcatataaaaaaagaaagtttttcttaaaaaagatcgtgcttctctatgaaagcagtgatataatcacactgataatgattctctttatcactaatttttatgaaagaaggagtgtcagatgttccatacatacaagaaaatcggcgcagcgctgattgccatgctgctcatcgccgctttggccgcatgcggcaattcttcagacacgaaaggttcttctgaaaaagaagaaaccatcacgtataaagccgaaaacggcaatattaaaatcccgaagcacccgaaacgggtcgtcgtcatggctgacggctactacggcgactttaaacagctcggcatcaatgttgtcggcgcgccgcaaaacgtatttaaaaacccttattacaaagggaaaacaaaaggtgtcacaaacatcggcgacggcacgtccgttgaaaaaatcattgacttaaagccggatttaatcgttgtctggacgacacaaggcgccgatattgaaaaactggaaaaaatcgcgccgacaatcgccattaaatatgacaagctcagcaacattgatcaattcaaagagtttgcgaaaatgacaggcactgaagataaagcagacaaatggctggctgaatgggataaaaaaaccgctgccgctaaaacaaaggttcaaaaagcggtcggctcaaaaaccatctccatcatgcagacaaacggaaaagacatctatgtattcggtaaagacttcggccgcggcggaagcatcatttatgacaaactcgggctgaaggccacaaaactgacgcaggaaaaagccattaatcaagggccgggctacgccagcatttcactcgagaaactgcctgacttcgcgggagactacatctttatggggccatggcaggccggcggtgacgacaaaggcgtgcttgacagctcaatctggaagaacctcgatgccgtcaaacaaaaccatgtctaccgcattgatccgatcggcttctatttctcagacccgatctcacttgaaggccagctcgactacatcacaaaaagcttaacgaagtaaccccgaagccgctgtcacagcggctttttattacgcttaaaacttgacaaaaaaattcatttatgctataatttacatttttagattaacatgtataataagattctcccggccggagattgatgtaaataacggaggatctttatatgaaagaaaacaaggcgagtatgacttccctgctgtgcgctttcggaagggcgtaccacagtaaatacgacaccccggtgatatttgatgattttttagcacaagatctgatttctgaaaaagagcattcggacatccgcgatcatctcattcaaggtatatcatttttcaataaagacatggcacagaggcttcaaggccaaccggatgacatcttaaaatgggtgactcaagtacagctgtctcctacaccgttagcccgtgccgcatattgtgaagaagtgcttttgaatgaagtgaagctcggggccaaacagtatgtcatccttggcgcgggactggatactttctgtttcagacatcctgaggtgacaaacgcgttagacatatttgaaatcgatcatcccgcttcacaggaagacaaaataaagagattgaaacatctgaatctcgacatttcccatcatcttcattttgtaccgatggacttcgccgcttcgctttctttcagccgtctgtatcaggaaggtttttcacgccaaaaaacctttttcagcctgctcggtgtgtcatactaccttacgaaagagcatctcgcccgcctgctcacacaattatttgccgaagtcccgccgggaagctctatcgtgtttgattatgcagatgagtcgctctttgaagaaagaggactgtcaaacagagtggaaaacatggtgaaaatggctgcagcaggcggagaaccgatgttatcgtgtttcagttataaagaaatcgaaaaaatattagaatcatcaggtctgcttatttatgaacatgtatctccggcggacgtcaatgaccgttttttcagcggacgcactgaccatttaaccgcatttgagaccattcattatatacacgccgtcaaaaagtaatccgctgccgcaaacaaaaaaagacatctcacagacgtgagatgtctttttgtcataccgatggtctgttgtttgcaaatttctttgagacgaaaggatataacagcaaaccgacgaaaaacagcccgataccgagaataaaggtcgttaaatcggccgttccggtaataatgacgtaaaaagaataaatgcaggcaaggatggcgatgataccgtctcttactcttgaaccctttatctcgtcatacgtttcacccgtaaaaatgagcttcaggctgtaaaacgctgacacgagatacggaatcagataagcgagcgtcgccgccgtcgttaaaaacgtaaacgcgtcactgatcgtccgggaaataaccgaaaagataaagatctgtgacattacgttcgttacgattaacgacacaaccgggcttccctgtttattcgtttttgcaaaagcagcgggaaagtctcctgatttcgccgcttgatacggaacttcagaaccgagaagaatccagccgagcatcgttccgaacagacacaaaattgccagaatcgccatgatgacgcttcccgcgctgccgacgatcgcgtacaatacgtcaacaaacggtttttccgagccgacaagcttaccatgcggaagcacgcccatcgtaatcaatgtcacgatgatatagatgccaagcgcgatcaataatccggtaatggtggcgcgtttcacgtcgcgctgcgaacgggcgcgcccggataaaatgactgccgattcaattccgacgaacgcccataatgttgaaatcgccgcattgtggatctgtccgccgattccctcaaccgtgtgaggacctgtttgaacaggaaaataaaaatgatcgaaaaacgacgtttgaaatacaaacaaacctgcaatgataaagaagataaatcctaatacttttgaaaacgtcgtgacgaaatttaatttactcgcaccgttaatgctggtgacgaggatcgtgtgagtgccccataataaaaccgtacatacggcaaacgtcagcagctggccgagcgtaaccgcctgaccgccgatcgaaaacatttcacgcttatccgttaaaatcgggaaaaatgatgttaaatatccggcaaggctcgtgatgatcgccacgttgctgatccagctcgccacccagtagccccacaccatcgtgaagcccgcagcattcccttttttccgatcgctgaacagcgcacgcgcatagctttgcggccccgccgtcagctcaggcttgcggatggataagtggccgaagaccagcgcgatcattaacacaccggctcccgttaaaagccatgccgatgtggcgccgaacgggctcgcgatttttgcgagcgtactcgggagcgaaaagatgcccgagcctaccatatttcctacgacaaacgccgttaataaccaaaaaccccattttttcgtctgttccattcctgtacctcctggttgttcattcgtacggaccagaccccgagaccatatttacacgcaaaaaaagcctgaacaaaagtccatgcttaaagaaacacacacacccttgatctccggatagccctccgcgaaaaagcacgcggcagtcctgcacttattcagatacagtcccagcataaagaaggatcggctttctttacacttcggcgctgatgcctttaacacatgttttgcggccccttatcagcctggcatgtgcgactcatcatcaagcgcaacctctacctcaccgagaaagagtgaggatttttatcattcaattctactcagaggttatcagagataaaaagatctgtcaaagggaaatattagatggaaaacggatagagcgttcgccctacccgtcttatatggtcagcggttgttttttttcttttgaacagcttcttgaagcggatcgtctttcagagctgcactggcgtcgtcaagcgcgccttgaatgacgtttttgtttttatcgctgttttttcctttttctttgttaaagaaagccatctgtatcacctctttatcaaatataggtacacctataatgtgtctttttccgcggcagaatatgcggaatccgcgtctccttccttttggcggaacaggtaaagtttgttgatcaaacatgcattctcttgatatatttgtaattcaggggattttggcaaaaataaaaaggagaagcgaaaaatgacaggaaaaacacacatcatgggaggcatcgcttcttgttccgcaattgcgtattattacgggtatgatccggtccttatgacctcagcgggtgccctcggggcgctgattcccgacatatgccatacgaaaagcaaaatcggcaggacgctgcccgttctgtccaaagtcgtaagcacggtgttcgggcacagaacgtttacacacagcctgctgtttatgcttattatgtttttcattacggcctcgtatattccgaatccgagcatttccgccggactgatgatcggaatggcaagccatcttgtacttgacgcatggaccgtcaacggcattaaactgctgtttccgtccgccatccgcttccgtcttcccctttatatgagaacggggagcttttcggagcagcttgtgctggccggcttaacgattgtatcctgctattatttatacgaactggttcacggccgcatctcttaaacaaaaagcgtcttttcgcttttagggtgaggagtcatacatatgaagaaaacctttttcagcaatcatcggtttttatgcctgtccatcctgttcatgtggatgaaaacctatgccgtgtataagctcggtttcggtctgcagaacaattcggttcttgaggaatgtctgctccttattaatccgctgagcttcattgtgccgctgttcggcatcaccctcttgctaacggaaaaaaaacagcggatctttctgctttcggcaaatgtgatgctgacgggaattttaatcgcgaatacggtgttttacgggttttatattgattttatcaccataccggttttgtttcaggcaagcaatatgggtgatatgggaagcagcgtccaagagctgtttcacccgctttatatcgctttatttttggatattgcgattttgttttatcttggaaaaaggcataaagccgataaaggaaaagcgggcgcccgtaccgttaaagcgtatgcgtgggcatcagccggcctcatgctgtgcaaccttgccctgtctgaggccgagcagccgaagctgttcaagcacccttttgatcgtgaagcgctcgtaaaaggaatcggcctgttccactttcatttgtatgacaccatttcgcagacgctgaatgcaggggctaaagcgttcgccgatgaagacagccttgcggcggtcgcgaattacactcaagccggctacagcaggccgtccgattcaaaattcgggcttgcaaaggggcgcaatgtgatttttgttacgctcgaatcaacacagcgttttgtaatggatgagcgggtcagcggacgggagattaccccgtttttaaacaaactgcgaaaaaaaagttatgacttcactcatttttatcagcagactgaacagggaaaaacatcagattcagaattcattactgcgaattcgctgtatccgtcttcaagcggcgccgtttttttcacaaaaagcggccaccggttcaatacgatgtaccatatgttaaaagatcatcaatactactcagccgttctgcatgccaatcataaagccttttggaaccgggatgagatgtacggggcattcggaatcgaccgttttttcgacgcggatgaatttaaggtgacacaggaaaattcaacaggctggggcctgaaggataaggagtttctcgaacagtcagcggaaaaattaaagaagcttccgcagccgttttacgcaagtctgctgactttgaccaaccatttcccttttgaaattgatcaacaggatcagctcattgaggaaccggacacaagcagcgagttattaaaccgctatgtgacgacggtccgctatgaagatgaggctctgaaacactttttcaagaagctgaaaaaagaagggctgtatgacaacgcgatgatcgtcctgatgggagatcattacggtatatccgaagcccataatcaaggacttgccgaattcttagggaaagaggaaatcactccgtttgatacggttcagcttcaacgcgtgccgtttatcattcatattcccggggtgaccgaccgtgcgccggaaacgattgcttcggccgcgggacaggttgatgtaaggccgacgctgcttcacctgctcggcattgaaacgaagggcagcattcagttcggcaatgatctgttttccggagagcggactccgtttgcggtgctgagaaacggcagctttatcacggacgatcatatttatacgaaaaatacgtgttacagccgtaaaacgggtgaaccgctttctgacctgagcgcgtgcagcgatgagaaagaaaaagcggaacaagagctgatgctttccgataaaatattaaacggcgacctgctgcggttttataagcaataaaaaaatccctccgttatatggagggatttttcatgtttcatatatgagccgtcctgtcattttcgtatcatatccggataattgagaaagctgagacttgaattcctcagaattaagaatgtcccgcacgctttgaacaagctcccggttttgttttaacacaaccacatcgtactgctcactgatcaccgggataaagtccgtgcctgccatatgcgccgcatgctgcgacccgactccgatatccgcctttccgcttgatacttgtgaagccgctgacagatgatccgtgacaatgtcatgatatccggcgacatcagacggcgtgatgccgaatgatctgagctgttcatccagcagcaccctcgcgcctgatcctttttcacgattgacgatgcggacatcctttttgctcatgtcctgaaagccctgaatgttcagcggattgccctttttcacatataatccggcctgccgcagcacgacatgaaaaagcgcaaacggctcccctgaaagaatgcgcttcacatacgggatgttatactgccccgtctccccatcgtataaatgcagactgacgatgtcacaagccccgcggtacatctcgatcaggctgttcaaactgccgctgtacttgcggagcggagccgcctgtattgtttgttccagctgtttgctgaggaggtccatcgacacatcctgcccgctgatgataacagactgccttttttccggctcccgcccgcgtgacgggtcaggcgcttctgctgcggatggcttttttgacattctcatgtttgctttatattgttttaagtcctcttcatcgaccctcatctgtcttccgaccctgtacgccggaatgagtcctttttttatcaaatcatatactgtcagtttggagaccttcaaaaggcccgcaacttcttctattgtataggaagtggcttctgtcatattatcacgctccgtttttattataactgttcagatattgaaaaaaaaccgcaccatcacgtacaattgcgttataattagtttgatctaatgatatttagctataaggggtgcacaatgttgaaaaagaaagcgacactactcacaactgcggctatggccgttttcctcgcaactgcgggctgctcatccggacaatcgtccaaaggcggacaaaacgaaaaagtcacgctgaccgtttctgcagcagccagcgctcaggatgcacttgaagaaatccagaccaactacgaaaaatcacattcaaacgtaaccattcaagacaacttcggatcatcaggcacattgcaaaaacaaatttcacaaggcgcgggagctgatttattcttctcggcagccgaagataaattcgaaaagctcgttcatgacggagatatcgacaaaaaggacagcacggatcttttgaaaaatgatctcgtcatgatcgtgcctgagaaaaacagcgcacacctgacacatctgaatgacctgaaaaaagacagcacggaaaaaatcgcgctcggcacgcctgaatccgttccggccggacaatacgccaaacagtcattgacggcattatccctgtgggacaaggtaaaagataaagccgtctatgcaaaagacgtccgccaggtgctttcttatgttgaaaccggaaatgtcgatgccgggcttgtctataaaacagacgcgctgatttcgaaaaaggtgaaaatcaccgatgaagcgccggcgaaaacgcacgatccgatcgtgtatcctgtcggtatcgtcaaggatacaaagcaccgtaaagaagcagaagcgttttatcagtatctgcagtcagatgaagcgatgaaagtgtttaagaaatatggatttactgccaagtaacattacggcttcggagtttttcactcccgtcgtactgtcgtttgaggtggctttggcgtcgggcatcgccgtcatcattctcggaacgcttgccggcgcctggatggcgaaagcgcgatttcccggaaaaacggctgtggagactctgtttatgctcccgctcgttcttccgcctaccgttgtcggcttcattctcattatcattttcgggaaacacagctttatcggccgggcgattgagcggatttttcaccagcccgtcattttcacgtggtcggccgcggtgatcgcttcggccattgtcgccttcccgcttatgtatcagtccgctaaaaccggcttcgccgcggttgatgctgacatcgagggagcggcgaaagtagacggagccggcaggtggcaggtgttcacccgtatttccgtcccgcttgcctttccctccctcttgaccggaagcattctcagtattgcaagggcgctaggtgaattcggagcgactttaatgtttgcgggaaatattcccggcgtcacccaaacgctgccgacagcgatttacgtcgcgatggactccggcaatgaaacactcgcctgggtgtgggtgatctgtattgtgatcatttcttttctgatgctgtttttcatccaattgaaaaaacccgcttgaccgatccgccttccgcgcacctttcgccgggaggctttttgatttaaaatcggatggtatataatgaaacaaaaacacacaaagggtgcggctatgaagattaatgtcattatcgcggatgataattctttcatcagagaaggaatgaaaatcattttgcatacatatgaggaatttactgtatcggcaacgttggaaaacggactcgaggcggcagagtattgtaaacacacccccgtcgatatcgccttgctggacgtccgcatgccggtgatgaacggcgtcgaagccgcaaaacggatcgctgaggaaacggatacgaagccgatgatcctgacgacatttgacgacgatgagtatattttagaagcaattaaaaacggcgcgaaaggatatttattaaaaaataccgaaccggaacggatccgcgatgcgatcaaaagcgttttcaacgggcacagcatccttcaggacaccgtgctggacaaaataaaagacagccttttccggccggcggaagccgcgcatcagattgatgaaagccagtttactgaaagagagctcagcatcatgtcgcttattgcgaaaggactgtcgaacagggaaatttcaaaacagcttttcatttctgaagggacgacggccaattatatttcatctattttagggaaaacggggcttgagcacagaacgcagatcgccattttttatatcaccgggaaggtggataacgggcgttgaacggtatggatttttggatgctgatgagcagactgatcgccattttttatacggcttttttgttcgtatcggctgaccgcccttacacgccgtacgccgtcttgtttctgctgctttatctgtctttgggcatcgcggtctgcatgatcaggccgcccgtttggaggcgcgggatcaccctcatggcgctggcattgaccgcttggctttccgccttaggccatccggcgtttctgtttcttttgccgcccgccatttttgcggttcttgccgaatatccggttcaccgctatgtgttctgcctgctcgtgtttttgccgtttttatttatcccgtacggcgaccttccgacttatatcgtcatgaccttgttctgtctggcgatattcgttttggccgcccggtccggcaatcggctgaagaaatatgaagaacagtcggacatcatgcgctcaagcattgaaaaactgacgaaacagctgcacagcagcacggaatatatcaaacaatcggagtacaccggcaaactcgaggaaagaaacagattgtcccaagccatccatgacaaaatcggccattccatgaccggcgcgctcattcagatggaagcggcgaagcggatgctcggctcccatccggacaaagcggctgaactgctccaaaacgccattaccatttccaaagagggcatagaggatatccgcataacgctgaaaaatatgaaaccgcccgctgaacaaatgggcattcacagattaagaacgtttattgatgaattttcggccaaaaacgggatgccggttccgtttacgcatcaaggcgatttggacaggctgacgcaaatgcattggagagtcattcaggaaaacgtaaccgaagctttaaccaatgcgatgaaatacgccgatgccacgcagattttcattgatatccatgtgctgaataaagccgtgaaagcggaagtgaaagataacggaaacggcgccgtccgctttaaaaaaggcctcggcatgctcggtatggaagaacgggcggccgtcctgcacggaaccgttatttttgacggcacggccggtttttccgtcacgacattgcttccggttgaataagtgaatgttttcatgtgaaaaatatgaagattctcatgtcaaaggaatgaacagctgcactaacggccgttcattcttttttttataataagagcatcataagacatagaggtggaaacatgaacattttggagctcaaacagctgagtaagaaattcggtgattatgccgccgttgaccagatgtcgcttgccgtaaaagaaggtgagattttcgggtttctcggcgcaaacggagccggaaaaagcacgacgatcaatatgatctcaggtcttttaaaaccttcaggcggtgacattctgtttctcggaaaagatattttcaaatatagcaaagcaacgaaaatgaatatcggcatcgtccctcaagacctcgcaatttacgaggaattaaacgcctatgaaaatgtgaagttcttcgcaggtctgtacggcctgagaggggcggctctgaaagaacgggtcgaggaagccctgacattcgtcggcttgagcgataaacacaaatatttgccgaagcatttttccggcggaatgaaacgccggcttaatatcgcctgcgcccttgcccaccggccgaaactgatcatcatggatgaaccgacggtcggtattgacccgcaatcaagaaattatattctgcaatcagtgaaaaagctcaatgaaatgggctgcacgatcatttacacgagccactacatggaggaagtggaagaaatatgcacacgcatcgccatcatcgaccacggaaaagtcatcgccgaaggcacaaaagaacagctgacctccatcattaccgacacgaaggacgtcgtgattgagctgtcatcccgaaacggcatcagcctcggcgatattcaggagctgcccggcgtcagagccgccgcactggaagaaaacagcgtgaaaatcagctctgacacaggggtcaacaatttaaaccgcctgatccggtacttcatgaacaaaggcattgaaatccgctccttgcaggaacaggcacctgacttagaaacggtatttctcacgctgacaggcagaagcctgcgcgactgaccccactggaaggaggattgcaaatgaatattctgcacatcgccgggaaagaaatcaaaatcagtttccgcgacagacggacttttattttcatgcttgcttttccgatcgtcttcatgctgatttttaccgcggcattatcaaacgcctttgattcagaggtgacggtcgggaacatcaaggtcgtatatacggaccaatcaaacgggacactttctcattactttactgagtttatgaaaaacgccaaaaaagagcatgtctattttcaaaaagcggacacggaggcaaaaggcaaaaacgaggttcgtgaaaatcaggcggatgctttcgtcactgtaaaaaacaccggttttcaagtctatacaaatgaccggagcggcatcaacggcacgatcgtccaaggcatgctgaccgcttttaccaatcaatacaaagcaggcgccgccgcttacaaggcgcataagccaccttccgccggacaaatcaaaagcgattatatgaagcagacgtctttacacaaagcgaaagaaccgaaggcgaaagatttttacgcgatatccatgacgacgatgatcgggctgtacgcctcgatttttgccagctccttattccgcggggaaagaatacggcacaccgcggatcgcctgatcgccgccccgctccggaaaagcgatatctttctcggaaagatgctcggcattttggctgtgaatgttctgacgattcttgccgttgtcgccttcagcaaatttatcttgaaagcgaactggggcagccacatgggacttgtgctgttgattctcgtttctgaaattcttttggccgtcagcttcgggctcagcctgagctatttgaccagaaaacccgaaagcgccagattaatcaccgtcatcatcgtgcaggtgatgtccattatcggcggcgcctattacaaatatgaaggaggggggatttccgccctgtcgcccttatcatggatcaataaggcgattaacaacatcatttacgcaaatgatgtatcagcggcatggcctgcactcagtttaaatacagcattggcggcactctttttgctgatcgccgcatttacgtttcaaagacgggagggactgtaatatgaaaaacttctggtggctgtttgcacacactctcaaaggaattacaaaaagcaaaaaacagctcattctttatatcggggctccgctgatcggcgtcttcctctccttcatgaccaatgccaacggcggagccgaaacgctcaatatcggcattctcgatcaggacggcggagaagtggcacaggatacggtcacgtttttaaaaggactggatcatgtgaagatttcggaggaaacggatgcgtccgcctcatcaaagatcgcttcaggaaaaatggaggcgctcattacgtttgaaaaaggcttctcccaaagcgtaaaagacgggaaaccgtctcacatcggcatgacctcgctgaagggcgcccaggtcaccggatatgtcagctcttatttgtacaattatatgaacagcgccgcttcaatcggcaaatcttccggcggagacgagaaagcctttcaggcgatgtacgccgatttcaagcattctccgattcaaacggagtccgctgttttgaaagatacttcgaaccataaagaaatgacttactcagtcatcgggtatctcattatcattatgctctattccgccggcaacctgacggaactgatgattaaagagagagaaaacaggacgtactacaggcttctgtcaacgccgatcacgtcaaagcagtatgtattggcgaatgcggcagtgaatatcattatcatggccgtccaaattatattcgccgttctctttatgggcgccgcttttcatattcatccgtcattcccgctgtggcagctgttcgtcctgatgatgctgtttgcattaagcgcaatcgggatcgcctttattgccgtcggtttttccaacagcagctcttcggcatcggcgcttttgaacttgatcgttgtaccgacatgcttgctcgccggctgcttttttccgggcaatattataccgaaaacagtgcagacaatcgccgaatttctgcctcagcgctgggtgcttgatacggtcgatcaattgcagcacggccgcacgctccaaagcctgacgctgaacatcatcattttgggagccttcgccgccgccctgttattaatagccgcatacaggttcagcgtaaaacgtcagacacagacatttatgtaaagaaaaacagccccgtaaagggctgttttttcttagaacagaagctcgtccggattcgggccgacacgctcgtctttgttcaatgcgctgatcttttccatttcttcctgtgacagttcgaaatcaaaaatatcggcattttctatgatgcggtgctctttaatcgatttcggaatggtaacgacttcgttctgaagatcccagcgcaaaatcacttgagcaaccgatttgttatgtttttccgcaatttgtgacagcacttcgttatcgaggagctgtccctgcatcaatggagaccacgcttccacttgaatgccctgcgctttgcagaaatctcttacttctttttgagtcaggcgcgggtggaattcaatctggttgaccatcggcttgatttcagcatctttcagcagttcttctaaatgatgcacttggaagttgctgacgccgatggcgcggatttttccgtctttgtacagcttttcaagagcgcgccatgtgtctttatatttatccttgcccggccagtgaatcaggtaaaggtcgaggtaatcgaggccgaggcgctcaaggcttttctcaaacgcgtcaagtgtcgtttcgtatccttgatcttcattccacacttttgacgtgatgaacagctcttctctggcaacgcccgcagctctgatgccttcgccgacaccctcttcatttttataaatagccgccgtatcaatgctgcggtagccgtttctgattgccgcttcgacggagtccgccgctacgcttccgttttccaccttgaagacgccaaggccgaaccacggcatttcaacgccattatgaagctttacagtatcttttaagctttttgccacgttgaaccatcctttctagtcattatgtaaacggttattattatctcacatttccgccgtaagaaaccaattatacgctcatcgttatcacaaaaaccatctttagtgcccaagcaccactgacgttattattttcctatttttcaaaaattatggttaatcgggtaactgtccgggtaaatcgctactgtagccaccacacaattgaaggaggaaatcatatgaaacgtatgcgtatcccgatgtccgttgcccttggcgccgctttgtctctgactcctctgtcctttgtatccgcaaaagaaaacccggcccctcaaaacatggctcagcaaacatcagatgtctcagcaaaagatgtcggattaaacattgacgttgacctgctcggcatcggcaattcgattgctgacgcgattaagtcggcgcaaaaccgtgacggcttcgtcaaaaacttaatggaatcttcattctacgcttccggacaaaaatataatgtcatggtgtttaatttaagccaggaatatgaagatcattttaacggcgttcagttttacggttccgccgtttatgacggcatcacgtacggcatttgggtgtttgaagacggaagcttcaccaacaaaggagatggcggctggatcaactgggccttcagaggctggtttgaccgcgacggcgatcacgtcgaattccatcgtccgtaatctaaaaaagtccggcgaacagatgccggactttttttattcatctccgtcaagcatcgccgcttccacatcattgatgtattggcgaagctcatgcgacatgtcgcgggaaatttcccgctcttcgaataatgtttggatttcgttgcggatggcctgcacggcccgcagtttgatttcgagtttttgattttcaaaacggcggctcggactctgttcgtgatacgagtgccccagcctgaaaatcaagtgattgtaaaaggaaatgacggcaagcgtcacatctttattttcttcagtcatgtgttttttcaggctttcaatggccgcttttgccgttttaacccttgtggagcgaatgaggccttcttcatttaaaatcgacatttccggctttttatgttcgccgaaaaagatccagtacatcaggcgtttcagctttttcttagataagccgactttaaacgggttcgtataaagcacttccagttcatcaaaccgttcctgaaggctgtcagccgtttcttccggtatgtcgccccgctcaatcagccgcagcaattcttcctgttctgcctgaatcccttgggcgcggactttccgctcatcttttttcgtgcggtttttgacggtgaactgctgaaacctgagatttttcattttctcattgtattcggcaatgaccgcaaaagaagccgttttgtttgactcattcatattttctttaatggcggttaaggcagcctttatcagcttccgtctcgctgtcagcaatttgactttcttctctttcacattgtcttccggcttatctgtcaaaatcggcagaacgattgtcgccagcaccaatgtgcacaaaataacgcccgcggctaaaaagagaatcaaattccgttcaggaaacggtgagccgtcagagagcacgtaaggaatggaaaaggaacccgcaagcgtgaccgctcccctgacgcctgaaaccgaaatcagcagggtcgagcgcaggccgggtttataaatgctctgatccttgttaaaaaaccacttgccgttccaaaaaaacagcacccacaaaaacctgagaatcattaacgtcagcgtaatgacgataatgtacccgatgaccatcatattgttaaacgcggtatcattaaagatgacggaaaccacatccggtatttgcgcacctaaaataacgaaaacaagaccgttcagaatgaacaaaataatattccacgtacttgaagagacgatttgcagtttgaccatcgttgattcaagacggtcctgctccaccgcatgcgtgatgccgccggccacaaccgctaaaatgccggaaacgccgatttcttcagccgcgagatagatgacgaacggcgtcagaatttgaatcagcatatgcatcgtgacatcctgcatgccgaggcgccgcataaacagccggaaacggataatcaaaaaagaaatgacgacaccgctgagtaaaccgccggctgaaatcaaaacaaagctgaacgcggcttgcgccagcgaaaatgcgcccgtcacggcagccgcaatcgcaaatttaaaagcgaccaggccggatgcgtcattcatcagcccttctccttcaaggagacgcagaatgccttttggcatcttcacacgccctgacagcgcgctgaccgcgacaacgtcagtcggtgacagtatcgccgccagcccgaacgcggcggccagcggaatgctcggaatcatccaatgaatcgtgtaaccgccgacaatcaccgtggcaaacacaagcccgagcgcaagcagcagaatcggcgctcttaaattccaaagttccgcacgcggcgtccgttttccatcgttaaaaagcagcggcgcgataaacaaaacaaaaaacaattcagtattcagttcaaaatgaagcccctgcggaaatgacgccgcaatgataccgagcgccacctgaatcagaggcaccgggataaaggggacaaaccgatttacgatatttgagatcgcgataatggttaaaagtacgagtacgactaaaaatatgtccaaagctgacctccttcatctgctgcatcatatcattattgcctgttctctgcccttgtcaaaggccggagccgatgatcgggcagattcaatatattttccgcacgcaaccattctccttttattttacccgtttttatttaaaatttctcataacgcgctcacggcgaactttttttgccttcagctacattttttccggaaaaagaaaaagcctgttttctctgaaaacaggctttttcgcaagctgcgtcatctgtttcatgacgcggggcagcgtttatgctgcttagtaaaggatagagaacgcaccgccagtgtgtctctatccttggttttaagagctcatcttattcgtgaaaattcgtgccgtctgtcgtcgctttaatgatgccggcgcggatgacgaaatcgccgaagtgttcgccttcctcacgctctttcgcgtagcgcgggagaatggtgcgaagctcattcagaatttcctcttcaccgatattttcccggtacattttgctcaaacggctgccgtcaaacgccgctcctaaatacatattatattttccgggcgcctttccgataaatccgatttcgccgagtgcatggcgggcgcagccattcgggcacccggtcatacggatggtgatttcttcatcccgcagcccgttttcgtcaacaatgtcttcaatcttatcaatcagcttcggcagataccgctcggcttcggccatggcgagcccgcatgtcggaagcgcgacgcaagccattgaactgcggcggagggcggaatgctgccagccgtctgtcagaccgtattgttcgattaatgcgctgatttgtttctttttctggctcgagacattgccgataatcaggttttgattagaggtgagacggaaatctcccgtatggactttggcgatttcacgcaatcccgtcatcagcttataattctcatagtccgtgacgcggccgccttcgatgaacatcgtaaagtgccatttcccttttacgcccttcacccatccgtaacggtcgccgttatggtcaaaatgataaggtttcgcttcatccagctgccagccgaggcggttttccagctcggcttttacgttttccagcccgagacggtcaacggtgtacttgaatctggcattctttctgacggaacggtttccgtaatcgcgctgaatcgtaatggttttttccgctacatcatacagctgctccggtttgcagaagccgatgacttttgaaagctgcggataagtggccgtatcgccgtgcgtcattcccataccgccgccgattgccacgttgaacccgataagacggccttcctccacgatggcaatgaagccgagatcttgagaaaagacatcgatatcattggacggaggcacggcgattccgattttgaatttcctcggcaaatacagcggcccgtacatcggttccgtttccgtgtcaggagttcccgccacacgttcctcatcaagccagatttcatgataggctctcgtgcgcggaagaaggtcatcgctcaatttcttcgaccattcgtatacttccgcatgaatttcagactggtggggatttgaagcgcacatgacgtttcggttgacatctccgcaggccgcaatggtatcaagcagcgccgcattgattttctgaatcgtttttttcatgttccattttaaaattccgtgcatttggaacgtttcacgtgttgtcagcttcaatgtattgtttccgtatttttgcgccagttcatccatgacaagccattgttccggagttgacacgccgcctggcatccggacacgcagcatgaactgataagccggttcaagcttttgtttttgacgttcattacggagatcgcggtcatcctgcaagtagcttccgtgatgcttcatcagccggttgtcatcgtccgggatgccggctgaaatccggtcgagcatgacttctttcaatgtgccgcgcaaataatcgcttttttctttaatttcctcaacatcacttggagggccttccggcgcttttaaaatgttgttcaccatgctgaataagctcctttcaaaccaaaatcaatatacgtcacgctgatagcgttttttctgctgcatgtctgccaggaagctttccgctttttcacggctcatgccgccttcttcctgaatgatatcgagaagcgcctggtgcacgtcatgcgccatatgctgttcatcaccgcagatgtatacggcggctccctgctgcagccattcatacagctctttgctttgttctttcatgcggtgctgcacatatactttttcctccgaatcccgggaaaaagcgacgtccatttttgtaagaacaccgttttgcagccatttttgccattccgtctggtacagaaaatcagtgacaaagtgctgatccccgaaaaacagccatgttttcccctcagctccggtttcttcacgctcctgcataaaggaacggaacggtgcgatgcctgtccccggcccgaccataatgatcggtgtatccggattttccggcagcttgaagttttggttgtgctgaatgtaaatcggaagcgtatctcccggctggagtctttccgcacaaagaatgctgcagacgcctttgcgttctctgccgtgcgcgtcatatctgaccgctccgattgtcagatgcacctcttccggattcgcttctaaactgcttgcgatcgaatagagccgggccggcattttacgcaggatcgaaagaaagtcttccgcggaagcttcccacggaccgaaatcccggacgagatcaagcagatcacggccgttggtgtatgctttcagctgctcttcgtttccttcggccagaagttcactcagcttttgatcagccgtaaactgtgcggccttttgcaaaagcggctttgttaagacggtaatttcaaaatgagaagtaagcgcgtctttcagcggacggcgctctccttgtttattcaccgccacttcctgttccggattccatttcagctcattgatcagctcatcaacgagcgccggatcattttccggatagatgccgaggctgtctccgggctgatacgcgaggcccgacccttcaagcgaaagctcgagatgacgtgtttctttatttgaaccgcgtccgttcagattgatgttctcaagaacctccgcccgaaacgggttcgttctggaataaacggattcaccgagagcgggcgtctcggcaggcgcttcggctgtttgatttcccgctccttcgttcaaaccgccgatgaccgcgtcaagccattccgaaaacggctcatcataatcaagatcgcaatcaacccgcggcgcaagctgggtgccgccgagctcttgaagacgctcgtcaaactctttgccggtctggcagaaaaattcatacgagctgtccccgagcgccaaaacggagtaacggagctcttcaagcttcggcgcgcgtctgccgtgaagaaattcatgaaaggccagcgcgttatccggcggatcgccttctccgtgtgtgctcaccacgatcagtaaattgtttacttttttcagattattcggcttaaaatcgttcatcgacgcgacggtgacctggaatccccgttcctcaagcgtctttaccgtctgtttcgcaagaccttccgcatttcccgtttgcgatccgtataatacggtcacttctttcgagactgccgggctttcagcaggagcctgagcagcgggcgcggctgtttcaccggattcggaccgggccgcagccaaatagccgctcagccagattttctgtgattctgtcaaggtcggcagaaggcggttaaggagctctgcctgctcctgattaaacggactgttcatgacctgaagttgcaacgatatccacctcacaaggaattaaacgtaacgtacgttatttctataggaattgtcaaaataatattctaattgaaactttaccgaaagtttgtatgtaagtaaaatatataatcatgatgacaacgattaagattactaatgataaaaagccctttgcactcagcaaagggcttatacgaataagccggcgggcacttcttttataaaaggagagggttctcccggagacaatacggtcaaatgatgcatcgcccgcgtacaggccgtatataacagcttacggtcatgttcgctattgtactgggcagcagaggcgtcagcggcaatgacggcgtcaaactcaatgccttttgccaaataaacgggaatgacgcatacccctttttgaaaaggctggttttctttattgattaaacggacaccgctctcggcgctgactgcctgaaacacttttttagcttccgcggccgttttgcagatgactgcgaccgtctcccagcctttttgtctgagctcccggattgtatccgccaattgttcccgccgcgcattttctgtatccgtccgcaaaacacgcggtttttccccgttccggttaaaaggctcaatgtcatcgccgtcagccagcagcgctttcgtaaattcaacaatctgccgcgtcgatctgtaagttcgcttcaggctgacatacttttctgcaccattgcgaaagcagccggcgagggaagaagggcccgtaatggtatgggcataaatcgactggctgacatcaccgagcaccgtcatctttgccgccgggaagatggtttgaatatacgtgagctgaaatggggaataatcctgcgcttcatcaatgaagacgtgcttcatttgtgtgttttttctttttccttctaacagatcctgcaaatacagatacggagcggcatcttcatacggaagcgaccgttctgcaaatgcgtttccggtcaaagcgccgatgctctcccaatgatcgggcttttcatcagctccccagtctgaaaacagccggagatacatccgttttatatcgagaaagccgagccgtctgacggcctgcttaatcggtttaaaggctttgccgacaataatggcgccaagcagccgctgttcgcgctgatggtcgtcaaatgcaggttcatcatctgccgcctgcttcttgagtgtttgataaacctcagcatagtcttccttatcaagcagctcgctctcctgcaagacccattccttcttacgctcctttttttcgagagcgctgatttccgcgagaagccattccgccgtcagctccgctctgttcggaatcggcagctgctgatcaagcgaataaaaataggcttcaatccgctcttttgaaatcaggatgtctccccggaagctgatctgtttacatttcaggccggagaccgaaagcgacccggcatagcggtcaatcagggcctggaaagctggtgacgctttgtaagcaatggctgcgagccttacggaaagtgcgtcctgattttgttcagtcaggcaatattcaagctgctcgtacgggctttcacaatcaaactttcgtccgagacggcggatgatatattcctgaaaggtggcctgctccatattctcttctcccaattccggcaatacggcggacacataactgttgaacaaaatgttcggggaaaacaatacaatctgacgggcatcaagcaccccgcgcccgcggtacagcaagtaagcggcccgctgaagcgccgcggatgttttcccgcttccggcggctccctgaacgatgagatatttgcttttttcatcccggatgatttcgttctgttctttttggatggttgacacgatgtttttcatatgctgtccggaatggccactcagcacctcttgcagcatttcgtcaccaatcgtcatatccgtgttaaacatcgctttaagcgtcccgtttttaatgatgaactgccgcttcagtgtgatgtctccctctatcgtttcttccggaacttcatagcgggcttttcccggggaatattgatagtaaagagatgagatgggcgcgcgccaatcataaatgagaaattgctcgttgttttcatccattaaagaagtcagcccgatataaatccgctcggaagaggactcccctttttccgtaaaatcgacacggccgaagtaaggagaggttttcagcttttggattttttgaagctgccggtattgaagccgatgcgtccgttcacgttctgaaagcatttccgcctgctgtttaatgcttgaaaatgtctcagccgcttcatgggcgtcatccatattcacggtgacatcatcccaaaacgtttttctcaggccgacaatatcctgcttcaatccgcccgatgatgtttccagagaccgctcttttttgcggagctccttcagcacttcatctattcttgactgctcttccttccattccttatcctgctgattcatgaacggcacctccaaaaaatagttgacaaacacatacgaaatactgtaaaatataattggatacatatatttaatatataataaaataggcaaatacaattcatcttagcacattcacccaatatcaatcaagatatgggttatttatatgcaaaaaaaccgatttcgctttgaaatcggtttttttgatgttagttacctaaacgaaaagaacggtttggcagctgccacttaaacatataggaacaaacgcggcaaacaacaagcacgaaaaacagaacgtacaagccaaacgaatttcccagccagcccaagcccacgattaaccctccgagcgcggcccagactgcataaatttccgccttgagcacaagcggctttctgcccgcgagcagatcccgtatgatgccgcccccgctgccggtcaggaccgctgccgcaatcaccgcactgagcgggtggcccattttcacggcatataaagcgccttggatggcaaacgccgaaagcccgatggcatcggataggttgccccatttactccaatgccttaacagcagcttcggaaacaaaaagacaatcgtaactgatgcgagagcgatttgaaaaaacgcgccttgctcccacaaggcggagaccggaacaccgatcagcaggtttcggatggctccgccgccgaacgccgttacaatccccaagatatacacgcctaaaatatcatactcctcttccatcgcaacaatcgctccgctgaccgcaaacgcaatgatgccgattacactaagcagctcccaggccattccatatgctcctttttatttgttaaattttctgacgaccattagattttataatcgctttctcttaaaatcaaccttatttttgaaagattctgattcctgatccgggacaacctcacccgcaacggctgagagcgagattattttcctattttatactttaatggaaggtttattagaagtttcattgaatactttctctaacaaaaagggggttatgagatgaaaatcagttcacttgtttttcctgttttattggccgccggattaattcccggcctgccgtcagctgaaagccatacgcattcgcacactcatgcggagccggcgaaaacggtgtatacggacccgcttccgaaagtcgatcattttaaagatctgaagagcccggtccaagttgaacagacggttgacacaaaaattctggatgaaaacggcaagcaggccggcacgaaacgattcaatgccaatgtcagtcaggataaagcctcaactaaagccagcacgggctcccagaaggtcagagtgctggcggtggcggacgctgaataccgcgccaaatacagcgactggcaaacgcgaatcgtccagatcgtggagcaggcggatgtcgcttttaaccgtgatcacaacattgatttcgtcgtacaggccgtgcaggcttggaattcttccggctcaaacagttctcagattttatcgaatctccaaggcagcttcagaaatcaaaattatcattttgtcgtcggttttaccgcaaaatcgagttttgacgccggcggtatcgcgtatgtatataacggcaaaccgagcggcccggctttcagcgtgaaccttgatcaaggaacggccaacacggcgaaagcggcacagcacgagttttcccataacttcggacttcagcatgacgcccaaggcagcggcatccgctgcgtcatgaattatgattatgcctattccgtggatatttgggacagctcccataacagacagattgcgacaaacaaagcttggtacagataatagaaaaagagccgctcccatggagcaggctctttattttgccgtgcgttccgttttgacaaaacacatgcagataataatgagaataaatgccgtcaatgccaagaaaggaatggtaatgaaaccgaaccagttaatatattcagatgagcaaggcacgccgtacacacacggcttgatgccgctgaaaccgggcaccttctgctcaaggtaatgcatgatcgatataaacgcgccgatgacggccatcggcagcacatattttttcacgcgcgtgtcaccctggaaggtggcgattcctaaaatcaggacaagcgggtacatgagaattctttgataccagcacagctcgcacggtatgaattttctgatctcgctgaaataaaggctgccgagcatggcagcaagagctatcacccaagaagcatataaaaatacgattctatttttcatttttcagctctttcttaatcgtttttgaaatctcctcataatcagagaagtctttaatcactttgtcatttacgtaaatcgtcggtgtcgccgtgatatttaatttatcattcaggtcagtgtcagctttcagctcttttgcgaaggtttctttatcaaggttttccttcagcttgtcaggatcaacctttttcgcggtgcttttgaccgttttttcaagcaatgcaggcgtgacccattcctgttcgcttgacggctgctgttcaaacagcttttcatggaaagtccagaatgatgccgggtcttctttccacacttcttctgaagcaagagccgccagacgcgagccgcttccgtggtacatgacgttcacaaatgaaaatttcacgtcgcctttatcgataaaatcttttttgattttcggaaagatatcgctgttaaatactttgcatgacggacatttgtaatctccgaattcaactaccgtaacaggcgcgctgtctttgccgagcacgggctgtcctttaatggaaggctgttcggcgactgtttcgcccgctttttccgtttggttgttaataattacgatggccgcaaataaaacgacaacgattaacgtcagaatcaccgcaaatttcgcagacgattgtttctttttcactcagacacctcattgtttttaaaataaaaaagaagcggatgccggatggcccgcttctctattttaccaagacaaccttgttaaagaaaaccctgaaaaacgaattatctttgacaattattccgctttcactctcatgacgcgcatcgcgttggcaacggcgatcagcgtgacgcctacatctgaaaagaccgcttcccacatggtggcgaatccgaatgcgccaagcaagagaaaaatgatttttacgcctaaagcaaatccgatgttctgccagacgatccggcgtgtgcggcgtgcaatccggatggcttcggctgcttttgacggctggtctgtcatcaggacgacatcggccgcttcgacggcggcatcagaaccgagagcccccatggcagctccgatgtcagctctggcaagcacaggcgtatcattaatcccgtcgccgacgaacatcagtttttcattcggtgaaagcgccgcttcaagttcttcgacgcggtctaccttgtcacccggcaaaagctctgtgtacacgtcatcaataccgagctctcggccgacagcttctccggtctgctttgaatcacccgtcagcatcactgtccgcttcacgccgagcgcttttaaattggcaatggcctgtttggcgtcctctttgatttcatcggcgatcacgatcgcccccgcatactgctgatccacggcgacatagacgacggttccgttattttcagctgtgccgaaagcgatttgttcttttgccagcagtttttgatttccggccaaaatcgttgacccgccggttttcacccgaatgccgtgtccgggtatttcttcatattcttcaatctcctcagccgcgagcggttgattgtaagcctcacgtatggaagaagcaatcggatgattggaatggacttctgcaagcgcggctgcatgaagcaggctgtcattcgtaaaccctgccgccggcttgatatcagtaacggcgaaattgcctttcgttaaggttcccgttttatcaaacacggcgtatgccacctgattgagcgcttctaaatagttgctgcctttcacgagcacccctgctttagacgcagctccgataccgccgaaaaacccgagcggaatggagacgacgagtgcgcacggacaagaaatcacaaggaaaatcagcgcgcggtacacccagtcggatagtgcggctgaaggcacgagaagcggcggtaaaaaggcgagaagcaccgcaacaatgacaacggccggtgtatagtacttggcaaacttcgtaataaagttttccgttttcgctttacgcccggccgcattttcgaccagatccaatatttttgacacggcagagtcttcatatcctttagaggtttcaatatgaagcacgccgttctgattcataaatccggccatcacctcttgccccggctccgcttttctcggcacggattcgcccgttaaagcggatgtatcaaccatcgaagaaccgctcagcacctttccgtccagcggaatccgttctccgggattcacgacgatgacctgtccgactttgacgtcctgcggcggaacggcagccatgccgttttccgatttcacattggcgtactcaggacggatgtccaataacgcgctgatcgattttctggatcggctgacggccgctccctgaaacagttcaccgatttggtagaacagcatgaccgcgacgccttccggatactgatgaatcacaaatgcgccgatcgtggcaagcgccatcagaaaatgctcatcaaatacctggccgcggacaatattttttcccgctctggctacgatatcgccgccgatgatcaaatatgaagcaaaaaagagcagaaactcaaggacggcgcccgtgtgcgcgaagtaagcgatgacggccaaaacggcgcccgccgccaatctcactaacatcagctgcagctttttgcggtattcatcctcaccaggtttgtcttcgtgcttcgaacgaacggtcacatgaggatcaatggactttacttttttcgcgacttcgtctttcatccattgctcgtttttcccgccggctgagaccgtgatggtgcttgccgcaaaattgacagcacagccgtctatgccgtcaatggcttttacgccgttttctattttttttgcacagttgctgcaatcaagtccgtctaatacaaattcacctttggctgctttcattttcgactcaccctactttccgtaataggattcccataacatcaatacaggcaaacgaatttatatatatgaacatatactcatatatttgttttctctattatatgcaggctttgaataaagtgtcaataaaaaagacaaaaccggcatcagccgattttgtcttttttcaccttctgtagacgcaaggcattaagcacgaccgataccgagctgaatgccatggcggcgcctgccacccacggagccagaaagccggctgccgcaatcggaatgccgatgctgttgtagcccaatgcccatcctaaattctgcttgatgtttctcatggtcagcctgctcatgccgatggcgtcggcaatgccgttcaggtctccgcggatcagcgtaatgtccgctgcttccattgcgatatcggtgccggtgccgatggccattccgatatcggccacagccagcgccggagcatcattgatgccgtcaccgaccatcgccacgcgccggccttctttttgcagccgggaaatttccgccgccttttgttcgggaagcacttcggcgatcacgctgccgatgcccgcggcttttgcaatggcctccgcggtctttttgttgtcaccggtcatcatgatgacgtcaagccccatatcattcagacgtttcaccgcggccggagatgtttctttaatggtatcggcgactgcgataagccccgccgctttgccgtctgccgcaataagcatcaccgttttcccttccgcctccaagcgggccatgtgcggaagcagtgcctcatgttcaatgtgttctgattccatcagccgtcttgatccggcaagaatcgttctgccgtcagcctcggcatagattccggaaccgatccgggcttgaaaccgggtgagtttcgggatggaaatcccccgtttttcggctcctgacacgatggcttctccgagcgggtgctctgatcccgtttcggcggccgccgccagccgcaggagttcctcttcgttcattccctctgccggtacggcatctgtcagaaccggtctgccgtttgtcaccgttcctgttttatccagtacgattgtcgtcagacgctgggtcttttctaaatgctctccgcctttaaaaagaatgccgaattcagctgcgcggccggagcccgccataatgctcgtcggagtggcgagcccgagtgcgcacggacaggcaataacaagcacggcgatgaatttgccgatcgcttcagaaaactgtcccggcgccgcccatacataccaaatgagaaaagtcagcacggccagccccagcacaatcgggacgaaaatgccggaaatgtgatccgcgagccgctgaatgggggcttttgatccttgggcttcttccacaattttaataatgtgtgcaagcgcggtatctttcccgacattcaccgctctgattttgagaaagccgtttgcattgatcgtcgccccggtgacactgcttcccggagacttatcgacaggcatgctctctcccgtaatcatcgattcatcaatcgcggaatggccctcaatcacttcgccatcgacagggacgcgttctcccggtttcacgtatacgatgtcccccgtccgaacctcgtcaatcggaatcacctgtaccttcccttcccgctcaaccgccgccgtcttcgcctgaagcttcattagctttttaatcgcttctgatgagcggcctttcgctttcatctctaaaagctttccaagcaaaatcaaagtcagcaaaatggcgctcgtttcataataaagcccctcagcatgtccgtctcgtccgagagacgcaatcgtcatgtacaggctgtatgcgtaagcggccgtcgttccgagcgcaacgagaacatccatattggcgcttttgtttctcagcgccttgtacgctcccgtataaaaaggccagccgatgacgagctgcaccggggtggcaagcgcaaattgcagccacggattcatcaggatatccggcatccagataaaagaagtaaaagaaaaatggctgaccatcgaccataaaagcgggaaggagagaacggcagaaaatatgagcctgatcagctgctttcgctgctctttctccttttgggataatccgccgtctccatcaaccgctttcttctcgtctaatcgatagccgagttttgccacggtctctttcagctctttcggcgtcacctctttcggattgtattcaacggtgactgtttccagggcgaaattcaccggtgcgctcacaacgccctctgttttgttcaggcgcttttcaatccggttggcgcaagcggcgcacgtcatgccttcaatctgaaaatcggctttttccgtcacgacgtgatagccgagtttttcaattttatcctttatggcgccagcttcgattttgtcaggctgataggaaatatttgaggtctcaagcgcaagattgacggaagcgtcattgacgccgtccatccgtttcagccctttttcaattcttgaagcgcaggcggcgcatgtcatgccccccacttgaatggtcatttctttcggttcactcaatgtcctcatctctcttcataaaccccacgggggtataattatgataaaagaaaaccgcgcccgttcccgcagcgcgataaaccttatacgacgtcatacccttgatcttcaatcgcgtcttttatatctgatacggagactttgttctcatcaaacgtcacatccacctgtccggcttccaatttcacctgaaccgccgtcactccgttcagttctcccactccggtctctactgcttttacgcagtgctgacaggacatgccttccacttgcagtgttttttgttccatgatgattccctccacgtcttgttttttcttcttcatgttaccatacccctgtagggtatttcaaaacattttattttacgattttgcgatttttttcacaacgtcaagcagctcggcaatcgcctgctccccgtttccgctctcaatggcgccggctacgcagtgatgggcgtgatcttccagcagatgaaacgcgactttctgcatggccgcctgcacggctgaaatctgcacgagaatatccacgcagtatcgttcgttatccaccatattctgaatgcccctgacttggccttcaatccgtttcagccggttcaggatctggtctttttctttggcgcttttatgatttaacgattgatgctcggtatgtttgtccattttccacctcggtttttttcttcgttatcttcattatacagacttgaaaatccggtgtaaaaaattttcaacacacaagttttaccagtacacccgcggggtatataatgttatcacatatcaagagggggaaattcattgaaaacgatacaggttggcatattgggatatggtttgtcgggtaaagtctttcatgcgccgcttttggacgtccttgatgattatcagatcaaaaaagtcatgacctccagaacggatgaggtcagacgtgatctgccgggggctgaagccgtgcgcgcgattgaagacattaccggtgatcctgacattgatctcgtcatcgttacgacaccgagcggaatgcattatgaatcagcgatgaaatgtctcctggcgggaaaacacaccgtcgtggaaaaaccgatgacggcgacttcagcagaagcggaggaactgagaagaacggctgaagataaaggcgtcttactgagcgtgtaccacaaccggcgctgggacaatgactttttaacgatacaaaagctgattcgggacggggcgcttcaagacattcatacatatcaagtcaactacgatctgtacaatccggttgtccaagaaagatggcgcgaaaaaagcggacccgccacgggaacgctgtatgatctcggttcacatattattgaccagacactcctgcttttcggaatgccggaatccgtcacggcacatgtgatgaaacagcgggacaacagtgaaaccgtcgattattttctggccgcgctccattacggcaaacttcaggtcattcttcaatccggctctatgaatgcggcaaacggcccgcgctatcagattcacggacggaatgcaagctttatcaaatacggaaaggacggacaggaagaggcgctttcagccggccaaaagccgattgacgacagctggggcgccgatgaccctgacaacttcggagagctgacaatcgcagcggatgaaaaaaggcatacagaaacaatcccctctgagaacggctcttaccttacgtactacaaactgctggcggacagcatcttaaacggaaaacagcttcccgttacggcaaaagaaggcatcgatgtcatccgtgtcattgaagcggcgatgaaaagcagcgagcaaaaacggacgattgccctttaatataaaaaacctcccagccgtacggcggggaggttttttttaagatcagaatgattttccggcttctttcgcgcgggcaatcgcatcttctttaatttgctgtgctttattcggttcagcattatggccttcaacgattaaaccgtcaaaagaaggaacgccgaagaagttcatcatgatgccgatgtaacggtggcccatttccatgtcagccgccgggccttcagagtaatagcctccgcgcgcctgaatgtggagcgcttttttgtcagtcaacagaccgatcgggccttgctctgtatatttgaatgattttccggctacagccacagaatcaaggtacgctttcataacaggcgggaatgagaagttccaaagcggtgtgacgaatacgtatttgtcagctgacgcgaattgatcgctcagctcgttcagacggccgactttcgctttttcgttttcagaaagctcttcaaatcctgtgccggattgaagttttccccagccgctgaatacatccgcgtcgatatgaggaatgttctctttgtaaaggtcgatatgtacaacctcatcattcgggtttgattctttataagaatcgataaacgcttttcctgtcgccatgctgtaagatgtcttttcatcatgaggatgagcagtgatataaagtacttttgccattgtaaacagccctttcgttttcaaattacacacacatttattatgaaatatgaatgtttttttatactgatcagttctgtaataattatagttacaaaaaattcttttcgcaacaataatatctcgaaatcagtatattttttaaaaaagactgtaatgacgggaatggcaagcagcagaaaaagcagaaacatttagtttctgctcaaaatcggatttggtttgcagatcggaatatccaacccgagattcccccgcagtgtatccgccggatagctttttcggtacagcccctttttctgaaggatcggtatgacttgatccacaaaggcttcaagcatgcccgggatgtcagagtgaatgataaacccgtccgccgcttcccgctgaaaccatgtttcaattaatgatgccacacgttccggtgtcccgataaagttcgttcgcggaaacgcggcttcgcgcgccacttgacgcagcgtaagattcctggctttagcctctcttttgatacggtctgtcgtgctttgaaacgcgtttttcccgacgtcgcccaaatcaggaaacggctcatccagcggaaaacggctcaaatcataatcgtcaaaaaatctggccacatatttaacggcgttctctatcggtatcagctcggcgaattcctgatatttcgcttccgcttcttcttgtgaaccggctataatcggactgattcccggaaagatccgcagcttggaagcgtcgcggccgtaatccgccgcccgcttcttcacatcatcataaaaagctttcgtttcctcaagtgaattggagtgcgtaaagactgcatcggcattacgcgcggcaaacgaccggccggtttctgaagaccccgcttggaaaacgaccggctctccctgtttggaccggccgatattcagcgggccctccacttgaaaatactcgcctttatgatacaggcgatgcagtttgtcagggtcaaaaaactgcccggtttctttgttgcggacgaaggcatcttcttcccaggaattccacagaccgcgcaccacgtccacatgttcctgggcgatggcgtagcgccggctgtggtcgggaagactttctttgctgtgattgcgcgcggctcccgcctgcggagaggtgacgagattccagcccgcccggccgccgctgatatggtcaagagacatcagctgtcttgcgatggtaaacggctcagtgaacgaggtggaaaatgtgccgattaaaccaagatgggttgtagaggcggcaagcgccgataaaatagtgatcggctcaaaccgatttaagaaatgcgggatggacttttcagaaatgaacaagccgtccgcaataaaagcaaagctgaacagccctctttcagcagtctgcgctttttgcctgtaaaacgccgcattcgtgcttgctgtcggatcggcgtcgggatgacgccagccgtccgttgtgccgccgacaccgtgaatcatggctccgaattgaattagatccgtccggctcattttctctccccctttttcccctcgtaatcggcaagcgcccgttctacatgttcaatgccgacttgagtaacggcctgatacacacggctgtcaccgctgccgatttcaacgacgggaacatgacggatgccgtacttcgtctgcagcacgtcacgcaattcgtcccgctctgtcacatcaattgtttcgtatgccacggctttttcccgcaaatatcctttcacttcatcacaataggagcagccctgtttgctccagaccactacgtttacttcatgactcatgttcatccctcctataattgtggggccggctgcaccgcttcgcttaacagccggtaagacaatcgtttttcctcagcgtttttgataggcgacaaaatcacaaaatcggtaatgctgtattgaacggataatcgtctcagctcggcggcggtctcttcttttgtcccggcaatcacacccgtcttttgtgtgatcagcttatatggctgcgtgacttgttcaagaaacgcttccgcttgttcccgggaaccgacattcacctttttgccgtcttcgagaatgattttgaccgactcacgcgatacgacgtgtttttccgcttctgcttttgtatgcgcggtaaataccatcggcgcaaggtgaaattccgccttcgatcctttcggcagatgctcgtcaaaggcgtggcgcgctttttctaacgcagcctcttcaccgtttatgaaataggcgaaaacgaaggaaatgccgagtttggccgcggatatcgcgctttccgcgctgccgccgagcaaaaagatgtcaggcgcatactcagtatgcggcgtcggccgcaatgacgcgtagcggtgcgagtccggaaaatcatttcggatgaaatgagtcagctcctcaagtttttcttcaaacaaacgggcgggctggataagctcccgctgcagcgcatcggttgacagctgaaatccgccgggcgctttgccgacaccgagcgccacacggccgggagcaagggcggacagaacccggaactgctccgccactttataaggactgtaatgctgcagcatcaccccgccggatgcgagacggatttttttcgtgcttgcggcaagataccccagaacaatttccggcgctgatcccgctatctcttcattgttatgatgctccgccgcccagaaacggtcatatccgtattgttcggcctcctgagccaatttcaccgtttgccgcaaggcttcttctgcggtttggttttccgcggtgacactttgatctaaaatgcttaaacgaatcatacgacaggctcctttatgcgctcttttatgtcataaccgtaatcaggcagcacgcggcggaggaacttcttcgttctttcttttttcgtcttgtgaaaaacttcctcaggcgttccttgttccacgattgctccttcatccataaacacaattcggtcggacactcttctggcgaattccatctcatgtgtgacaatgatcatggtagcgccggtccgcacaatgttaagcatcacctcaagcacctcgccgacaagctccggatcgagggcggcggtcggttcatcaaacagcatcacatcaggatgaatggcaagcgccctggcaatcccgacccgctgcttttgtcctcccgacagttgattcggataggcgtgtagtttatcctgaagccccaccttggccagttcccgctcggcaatggcgtacgcgtctgtttttttcattttccttgcgaccgtcaggccttccatgacattttgaatcgccgttttatgcgaaaacaaatgatattgctgaaaaaccatcgctgtctgtttcctcaatctgagaatgtcttttttggcaggctttttgcagttaatgacttctccgtgcagtgaaatggcgccctcatccggccgctcaagcaaattaaggcagcgcagaaaagtggttttcccggaaccgctcgggccgatgatggtcacgacttctcctttccggacacttaaattgatcccctttagcacgtgatgactgccaaaatatttctgaatgtttcggatttcgatcataatgcgcctccttgatatctggccgctcttttttccgccagactgtttacagcttcgagaatcagcgttaatccccaataaatcacggccgccccgataaatgcttccagaaacgcatagttatcggatgccgcaatcgtcgccgttcctgtaatttcaggcactgcaacaattgccgcgatggaagtggtatgcaaaaagccgatgcctatattggtgaagttcggcagcgatatcatgaacgcctgcggcagaattacgcgccgaatcatctggccccgcgtcagaccgattgaatatgccgcctccgcctgccccgtatcgacggccatgatcccggatcggagaatttccgtcatataagcgcctgccgttaatgacagtgccatgatgacaaacacggcgaccggaatctgattggccgaccagccgagatgaaacgcgcggctgaattgatcggcaatcagcggaacccctaaataaatcagcatgatatggagaatcgccggggtgctgcggaaaaaagacacgtaaaacgctgagcaggccagcagccatttgatgcggaatatacgcaccgtgatattgccgagagctatgaaaaatccggcaataatcggaatgatcgtcatcgccaatgtaagcggaacggttttcaacatttgttttatcgcagtgccgataaatggaatgtccagctccactgttctccctccttttcagccgtgcgcgctcatgtcaaaaaccgtcacaaggcgcgtctcatctttcttgattcgtttttcggcccatctgaatacacattcaaataaaagggcggccgcataatacagaacagacagcgagatatacacttcaagagaatgattgctcgatgtaatcaaggtctgtcctctgcccgacatatccatcaccccgatcgaaaaagcgagtgatgtatcttttaagaaaccgatcaccatattcccgatgttgggaaaggcctgcacgagcgcctgcggcagaatgatgcgccggaatgtctgccccccgttcagcccgatgctgaacgccgcctccgcctgcccgcggccgacgctgttcacacctcccctgatgatttcggccgctcttgccgcactgctcagcgcatacgtggcgatggccgcatacaaagggtccattttagaggcatcaattccggcgagcgccgtgagcgccggaatgccgtaaaatacaatgaacagctgcaccatgatgggcgttcctctgaaaaaagagatatacagcttcgcaaactgattcaaaacgggaatgcgatagatgcggggcagcgccaaaagcagccccaatagaaagccgaacagcaaagacaccgccaatatatacagcgtgacgggcaaatacccgagcaatgtcggcacaaaggacgcgatcatactgatatcaaacgctttttccattgccggtccctctctttttcacttaatattgctcctttgaataatccgcgccgagccacttttcactcagctttttaagcgtgccgtcatcaatgatttccttgagcgctttatcaatgtcatcgctcagcgtttgttcatttttgttaaacataaagaacactttggcctttgacagcaccccgccgaccgttttttctttgatcgcgctcgttttgttttgaaaatcgacagcaaacggcgttgaaatcgtggcatcggcgcggccggatttcagctgattggccgcatcgtttgaaccttggccggcataggcgatttcaaacggactgccgtgtttttcattccattttttcaggacaagcgcgccgtttgacgtcggacttgtaatgacccgctttcctttcaagtcattaatgccgtgaatgtccccattatcttgaagcaccgtgattttcagcgggaagttgttatacgcgacttgattgaacagaaattttttctcccgttcggcgcttttctccatttgatgagccacgatatcgactttatgctggccgaggctgacaagcaggttggagaaatccatcgttttaaaggtaaatcgatagtccggcaggcgcctgtcaagctctttcaccagctcaacgtcgtagcccgtcaatttgcctttatcatcaataaagcaaatattcggaaattgagtccccgtgccgaccgtaatgttcttcacgtttttctgattgcctgatgccgcctcccctcccgcgccgcaggctgataacgccgccgttgccgcaattgttaatgacatgaccgccagtcttattttcatgtgatcgccccgttttctgcttcaattatttcgtgaaacttgattttgaataatccgcgccgagccatttttcactcagccttttcaatgtgccgtccttctcaagcttttgaatcgcccggtccgtatcgtccgccagggtttggctgtttttattgaacataaaatacacctcggtatcgagcagcacatcaccgaccgtcttttgtttgaacgcgtgcgtcttattttgaaaatcgacggcaaacggcgtggatacggtggcgtcagcgcgtcctgtctcaatttggttcgctgtatcattgccgccctgcccggcgtatttcaaatgtatcgggctgccgtgggttttgttgtatgccgtcatataatccgccgcgtttgacgtcgcgccgacgatgacggttttcccttttaaatcccggagcgtgcgtaccgcgtcattatccgccttcaccgtgatgtacatcggcgagtagttatacgggattttgtgatacaaaaagcgtttctcccgttccttgtttttcgccatattgtgcgcgatcacgtcaattttccggtttccgagacttgtaagcagattcgaaaaatccatcgtcttaaagacaaatttgtattgcggcagctgttcatcaatggctttcatcacttcaatgtcatagccggtcagctcgcctttttcatccataaaagcaatgttcggaaaatcagttcccgtgccgacgatgacggtctgcacgccgctccccgcttttgcgctttctccttgcccgcacccggccagcacgccgagcagcagaagcagacagccggctctgatccgttttttgatcattgcgcccagctcggtgtgcctaacagcgacgcgtcaaaccgctccggtatgagcacctttctcatcataactccgatgtctccgtctttctcctgctcaaaatacacttcatatcccctccgtctgtacatatctacaagccagggatgcttgcgcgccgaagtgccgagcgtgatggccggggccttcagcgtatcccgcagcacatgttcctccacataagtcaaaagtttgctgccgatgccctgccccttcagctcaggaagcgtcgcaaaccaccagacaaacggatattttgacggaggcgtgtcactctcccacggaaaacggatcgtaatggttgaaagaagccgtccatcccgttcgagcacgacggctgaatgattttcaatattttccgttaccatatcgatgtcggcccgcgccgacggccagtcaatctccaaattgcggatcggctgaaacgcgctgtacagcagctctaaaaactccggcgcatcctttttctcagccaatcgaaatatgtcttcactcattccgttcactctccccgcaaaaaatatataattccaatttgtttactaagctttgattgtttatactataaagcaaactgatttgtttgactaatcaaaaaaagtaaaggaaaggttcaagaaaattaatgaacagccgggaggggatttcgttggaactacgaaccattaaaacgtttcataccatcgtacagtcaggcagcttttataaggccgcagaaattctgaactactcacagccgacgatttcaatgcggattaaacagctggaacaggatgtaggcgcgcagctgtttgaacgtggaaagaagctgaagctgacaagggcggggcggctgtttcatgagcgggccgggcagcttctcgcgcaatacgaggtgcttgaccatactctggccgatatcagacagggccaggccggccttattcagatcggcatatccgaaccgacggcaagcctgatcttccctgccgtgctgcggggtttcttaaatgattatccggacatgtcggtcaatgtcagcgtggatgatgccaatacatgcagccgcaaactgctggagggcgccattgattttgcggtatgcggcgagccggagctgattctggaaaattatttcgatccgtttttccatgactcgctcaatgtcatcgtgtcagacagacatccccttgccgccaaagcaagcgttaatctcgaagatttagaaaatgaatgcctgatttttacgcccgccaattgcccgatccggattcaaattgaacagcacctgcagcgggccatcggcagccgctatcgaaaaatggagctgaccagcagcatggctcatcaatactatgtcagggaaaatatcggcgtctcaatctttacggcgacggcgcattcagagccgatcgagggcacgaaggtcattccgatccataacttaacaatttcaccgcctgtcgggcttttgacaaaccaaaaagaagagcactttgactgtgcaacaaaagatttaatcagcaggatcatcggccggtttcagcgtgatccgcattaaaaaaacccccgccactttgcggggggttttttatgttcatcttatataatactccgcaccaagccgccgtcgatccgcaatgcagatccgttaatggcagacgacagcgggctgcttaaaaaggcgacaaagtgggcgatttcttccggacggatcaaccgctgaatgatggacgtcggacgattttccttcataaatcgtctctccgcttcagccactgtcaagttttcaccgggataaagcgactcaagcattgtttcgacgccctctgttttcgtggagccgggcatgaccgtattcaccgtcacattcgtcccttccgtgagctcggccaggctgcgtgacagcgacagctgcgttgttttcgtagcgctgtaatgagccatttcctgagaaggcatgacggccgcttcactcgcgataaagatcacccgtccttccttccgctcaatcatccgctttgcataccggcgtgtcagccgcacgccgctcatgatattcacctcgaaaaaccggagccactcttcgtcaggaatatcaaagtattccgcaggttcaaagattcctaaattgttgacgagaatatccacatcaggatactgctgaaaaatcgcgccgcatccttccgccgtgcctaaatcaaacgcggccggatagagacgggcatccggcgtctgtttctctagttcccggatcgtttcgttcaccttttcttcacggcggccgttaatgatcacggccgcaccttctgcaatcagcgaagccgcaatcgccttcccgatgcctgacgtagatcccgtcacaagcgccgtcttccctttcaactgcaagtccatcatccattcctccctatcgcaagtctcttcttatatatggacagaaatcgaaagcctgaaaccttccgtccctattatcggatagaaaaatggatgaggggaagtacgcactttttagtgcctgtccgttgtcccggctgacggctgatcaatttgaatgaaaaattcaccatctaattctgcctgagcctcttgaaacagctccaagacatcatcagcatccgaacccaattccttctgactgatctcaaaattcttccacaccaaagtcagcggaagttcgatccagcctgtcagacaatcccataaggcgttcagattttcaccataaaagtccgggaaatctaattgatcttttaagattcggtgtaaagcttctgtgcttgtaacatcttttccgtctatgatgacgatttccatttacattcactcctttttgtcggcataaaaaaaccgcagtgcgtcatgtgacggcactgcggttcctctgttatgtatggagacggtgggagtcgaacccacgtccagaaacatcgattacttaagcgtctacgagcgtagcctgcatatttcgtgtttcactcgtcttcatgcctgcgggcgggccttccgagagctagtctgtcagtctcttcttacgttctcagacgggaacgcaagcgtagcctacttggatgtgctcttcacggacacataggcaatgtcaggaagagctcgctgcgtttattaggcagctagtgctaagttttggttaaaacttttagttttgccagttatatttaggtgcgtgttaacgagatcgcctctcggctcgcagctcaagctcgatccatccctgtcgaatccgtaacgtccccttgttaagggtatacgggagatctatcaagctcttgctcaactggctgtactgttattataccatgatcacaggcaaattcaattgggaatatcttcaataaacagcctgtgaatctgatgtgtgaacagtatagcacagggcatatcatcacatcaaggctcaggcatcagaagcctttttgtctgtctctgaacgctctttcgatttctcttttggcgtcttttcgttttaaatcttcacgtttatcgtatgttttcttcccttttccgaggccgattaatactttggcgaagccgtttttcaagtacagcttcagcggcacgagggaatagcctttctctttcgtcaggccgatcagcttattgatttctttccggtgcatcaaaagctttctcgtccggagcgggtcgtggttatagcggtttccctgctcgtacgggctgatgtgcatgttgtggaggaacacttcgccgcgctcgattttcgcaaaggaatccttcatgtttacgcggccggcgcggatggacttaatctccgttccctgcagcacgatgcctgtttcataggtttcttctataaagtaatcatggtttgcttttttgttttgcgataatactttgcctgatccttttggcatgccttatcctcctctctccgcaaaaaccgttcatgtgtgcgatacgctttattttagcaaatggagcgttccgcgacaatgaaaatgcggcttgcgaaagaaagcaaacagagcattatgccctatttgcttttcgcatttacttcttctttttgcgtttttgtttcggcgcgttttggaaaccgcgttttttctttttcttcttcggttttgtaaaccattcccctttttcctccgatttcggcggtgaagccggggtattgctgtttaacacgcgtttccgcgccggtctgcctcgttttctgcggtcgcctgttgtttctctcggacggcgggtgcctttcatgccgacaatttcaaagtcgatgtttctctcatctttattgacgtcgacgactttgaccgtgatttcgtctccgatgcggtaaacgttgcccgtgcgttcaccgatcatggcgaaatgctgctcgtcaaaacggtaataatcatccgtcataaagctgacgtgcacaagcccttcaatcgtattcggcagctcgacgaacattccgaaattcgtgacggaactgatcatgccgtcaaattcctcgccgattttatcaagcatatattccgcttttttcagatcgtcggtttcccgctcggcatcaacggcgcgccgttccatcgttgacgtatggtcagcgatttccggaaggcgttcggcccacttttcctgagttgcttcgtccgattgtccattgatcaaatacgttctgatcagcctgtgaacgattaagtcaggatatcggcggatcggcgatgtgaagtgcgtataaaattcagtcgccagcccgaaatggcccaggctttgcgggtcgtatttcgcctgcttcatggaacggagcatgacggttgaaatcaccgtttcttccggacggtcccgcacttcatcaagaatgctttgcagcgcgcgcggatgaatgtctccggctttccctttgacgatataaccgaatgtcgtcacgaactcgagaaacttttgcagtttttcggcgttcggctcttcgtgaatccggtaaataaacggcacgttcatccaatggaagtgttcggccaccgtttcgtttgccacaagcatgaattcttcgatcagcttttccgctactgagcgctctctgatgacgacgtcttttacggcgccttcctcatcgacgagcaccttcgcctctttgaaatcaaaatccacggcgccgcggtccatccgtttcgcccggagaatttccgccagacgttccatgtctttaaacatcgggacgagcggctcatatctttctttcagctcggcgtcgccttctgtaaggatccggttgacatctgaataggtcattctttccgtcgttttaatgacgctttggaagatctcgtgctccgtcacctgtccctgctggttgattgtcatttcgcaggaaagcgtcagccggtcgaccttcggatttaacgaacagattccgttagacagtctgtgcgggatcatcggaatgacccggtcaaccaagtacacgcttgtccctctttccagcgcttctttgtcaatcggggaattctccgtaacgtaatggctgacgtcggcaatatgaacgccgagcttgtagctgccgttatcaagctttgtcacggtgacggcgtcatccagatccttcgcatcggcgccgtcaatggtgacaatgacctgatcgcggagatcacggcggtctttgatgtctttttcatcgatggtatcgggcgtgcttgttgcctgctccatcgcttcagccggaaaatctcccggcaggccgtgcttatggatgatggataaaatatcgatgcccggatcatttttatggccgagtatttcaacgatttccccttcggcgttcattctgccttcaggatagcttgtcagtttgacgacgactttatggccttccgcagcgccgttattggcatgtttcggaataaaaatatcactcgtgattttcttatcatccgggatgacaaagccgaagcttttcgtttctgtgtatgtgcccacgacgcggtcgatgcttctttccaggatgcggatgaccgtgccttcctgtctcgatccgcttgactgggaattgagccgcaccatgacaatatcgccgttcatggccgtattcagctcgttcggcggaataaacacgtcgcttaaagaggtatcctccggcagcagaaacgcgaagcccttcgcatgcgcggaaatttttccttttactaaattcattttttccggaagcccgtagcggttgcttctggtgcggacgatctgtcccgtctcctcgagcgccaccagcgcttttaccagctctttaaattcatcggcttccgtgatgttcagcatctcctcgagttcctgaatggtaaggggcttgtacgcctcttccttcataaacgcgagaagacggtccataaacgcttctttttccattattcgacctcctgtttgttaccaatcgagtttctctaaaaattcgtacacatcctgatgaacgaggtcccgttctttatcgagtgtaatgacatggcctgattcttcataccatttcagctgtttgtcgtccgtttccacctcgttgaaaatgatgttcgcactttctgtattaatcatatggtcatgccgtgcctgaaccacaaatgtcggggaatagatcatgtcgacgtttttgcgcacatcggcaatcagctcctggagcgatttgagcgtattcatcggcgttttttcaaactccttcatttccttttcaatctgctccggctgttttccttcgaattttttataattgcgcgcgtaggagagaactccttcgtacataacctcttcacttttaatgtgcatcggcgcacacataggaacaattccctttatgggtacagtgtaacccaatttcaatgaaaaaaccccgccaagcgacagtccgcacgccgcaatgttttcatagccttcagaccgtaaatactcataaccgtccatgacgtctttccaccaatcttcaggtcccgtatgtaccagctcttccggcggaacgccgtgccctttatattgaggcgcgtgacaagtgtagccgcgctcattcaagtagcggccgagcattctgacgtctgccgtatttcccgtaaatccgtgcagcagaagcaccgctttgtctccgcctttaaatgtaaatggttttggtgtcacaattttcatgctcataaccccttttttgcacattcaatttagttttccacagttttgcgagaaacaaacgccgtctctcaacaagaaaaaggcctgatattaaatcagaccttatacaaacattgccttatacgatatacgctagcgaaatcgtcaacacgaaaaacaagactgccagcacaacggttgtgcggtgaagaatcagatcaaggccccttgctttctgttttccgaaaagctgctccgccccgcctgaaattgcacccgataaaccggcgcttttgctggtttgaagcaatacgacaataataagtgcaatactgacgataaccaataaggtaatcaataatgtgtgcatcccatacacctccagactgactggcctacattgcttctattttacatgaaaaacaaaggcatgtcacgccgtatcggtgcacatcatgtcagaaaaacggaaatgcgtttgaatcttccatcttcattgacttttgtcaacaaagtcgtagtaaaaaagatcttcaaatttcatgtcaaagtaatagagcatttttccgatgaccagctggcccggccttcgctctccattcagtacacggctcagtgtggcgggagatattccgatctccagggcgagctggtttaacgagtagtcattattgaccatatactgcagcacataatctcttctgatctgtatcttttcgaccactttcttcaccttccgttctgtcaaatactttctttcttatacataagatacggcttttgttaacttttgtcaatacttttccagcctggctattccctttagtcaataaacatactagaatataaatagaccgcgggagggggagagactgtggaaagcttcgggaaacaattgcggacattacgggaaaaaaggcatctgacagtgaatcagctggcaacgtattcaggcgtcagcgccgcgggaatctcgcggattgaaaacggcaaacgcggggtgccgaaacctgcaaccattaaaaagctcgcagatgcgttaaaaatcccgtatgaggaactgatgcagacggcgggatacatagagaccgtccaggaaacgagagccccgtacgacacgggctgcaccttgctggaaaaagccgaaacgtatgagctgcatgatttatcccttttggagcgggagaactggcggcacctgtcgaaagaagacttggttctgcttgataaatactttgcgttcttaacagcggaagccaaaaaaagaacaaatgaagactcatgactttgcacatgtgaggcgatcttattgaacacattcggaaagcaattaagagagctgcgccgcgcccggaagcttaccgtcaatcagcttgccgtctattccggcgtcagctcggcgaccatttccagaattgaaaacgggcaccgcggcattcctaaacccgcgaccatcagaaaattagcggacacattaaaaatcccgtacgaggagttaatggcgcgggccggacacatcaaggcatttcaggaggaaatccgtgaaacctccgaaagctatcaatccatctgcgccatctatcagaccgccgttgacagaggcgcggagcatctgccgctgtttgacagcaaaaagtggcagcacttcacaaaagaagatattgaaagcgtcagcaaatactttgattttattgcggctgaagcgaaaaaacgctccccggattcctcatcctctttttgatcctctcctcaacttaacaagcgccagacgtacgttccctccgattttgcggtataatagcagaagacgaggtgaaaaagcatgaaccaatcagaaatgtgccccagattcgaaaaagcggtcgacatcctaagtaaacgctgggtggctctaatcgtctttcagttattgaacggacagcagcgatttagcgaaattgaagcggcgcttccgaatttaagcggaagagtcttgtcagaacgtctgaaagaacttgaaacagaaggtgtcatcaaacgggatgttatccccgaaacgcctgtccgcattgagtattctttaacggaaaaaggctgcgcattagcccctattttagaggaaatttccaagtggtcttcaacatggattgatccttcctgataaactcttttccgcataagcggctgatctctcaaacggacagccgtttttatttttgcttttcttatacagaaaaacaagccctcaggcgtgcagggcttgtttttgtctgacgccttccagcggaattcgaatctccgcccgggctcctccagactcctgattttcaagtattaattcgccgtgatgaagatgtacgacgtgatgggcgaatgtaagccccatgccgtgatgccccgccgaatgtctgcttttatcctccgtgtaaaaaagctgtgtcgctcttttcagcgcctccggcgagaacccgcttccgctgtcggatacggcaagatggagggcggaatcggtgcacaggacgtccacacggatttcccctccttccggcgtatagtcgacggcatttgccgcgatattcatgatcgccctgtggagcagctcatgatcgatcggcgcttctattcggtcaattccccgttcgctgaggacgagatcaatctgcttcggccccgcaagcgccgccgcgtcacgatatatgttttgaatccactctttgaggtcggtatattcgacatgaacggcaactgcctcctctgctttggaaagctggatcagctgtccgacataatgctcgattttgtttccggcatccaggatatactgcgcatattccgcctgctcctcatcaggttctgttaactggagcagctcggcatttcctttaatgatcgttgccggaattttaatatcatgcgcaagcgcgccgatctgttctttctttatccgctccgcctcccactgcgccgccagagatgcctgaagcgcgtctttcattttcagcagagagtcaatgacatcgtcaaattcttttatacgcgaccttttgggattgatatttaaattctgtttttgaatgcttgccgtaatggagctgagtgtgctgaaatgccgtctcagctgattggcgaaacgcgtcgtcacgataaaaacagtcaaaagaagcaaagtgatcagaatcgtaagacccgtccattcataattcggcagatagcgccttaacagcggcgactgaaattccgacctgagtgaatattggagaacgccgtattcatctttccgatttatcaccatgaatcctttttgagcataattaaaatacggctgatgctgaatcttttttctggcgttggccgcatcttgttccgtcatcgttccttttgtcatccgctttgtttttttatcaaaaacggcgtatgtcatacctgcggggatcatgtcttctgttatcttttccgctgatttcaggcggggtttgatctgttccgcctcatgctcgctgtagtttgcgggcaggatcgctccggcattcatggcaatggcatttaaggcgacgcataatgccgccacccccatcgtgctcagacacaaagtgatggtaaatttgacaagctctttgcggatgctggattttccttttgctattcccatttgtatccgacaccccacaccgttttgatcggatcagccccgtgttctttacattttttccggatggttctgataaactccgtaatggttgaatagagcgcatcgccgtccaagccgtacacttcctcgtaaatctgctcccgtgagaatgttctgtttttatgctgtgccagaaattcaacgattttatattcgtttttcgtaagaggcagtttccggtcatccatccatacttctttattgtcaaaatcaaacatgaagcctgatatcagccgtttcgtctgatgcttttcccgccgttcccttctgacatgcgcgtttacccttgccatcaattcctgtacgccgaacggctttgtgatgtaatcatcagcgcctgtcatgaggcctttcacaatggattcttcgtcagactttgccgttaaaaacaggatcgggctgtccaccagcggccgaatccgccggcagagttcaatcccgtccgttccgggcatcatgacatcaagaagaatcaaatcatagccttgaaaaaaatccaatgactgatcttccgctttttcgagaatcgttactgtatgctgatcacgctgtaaaatgtttctgatcagaacgagaatatctttttcatcatcaattgctaaaatgtttgccaccggccgaatcgctccttgcctttattcatatgaacgccgcccttcccatcttctgcaccaatagaggccggccagacataatatcactatagaaaaatataacattatttctccgaatctcatatcgtatcttacataagggaggaactcttttttgactttgtcaaaatgcagcagtcctgcaaggcctgaaagcctcacgctccatgcccacggaaaaaaacgccagatgatatcgccaagtcccgtattcatgagcgctgccattaataatcccgcaccccctaaaagcccggacggtcccatgccgtactttatgccgacaaaaaaagacatcatataaagcggaatactgccggcaatcagccacgcccctccttttaaaaagagaagatacgggagatcattgatgtgaagaacaaatttcaaccccgccaaataaagacagatggcgagacctgccgataacacattcaataggagcagcagaagcagcttgcccgcaaaactgacgattttagaatacggaaccgccagcatcatctgaaaattgcccgcctgttcctcgacagaggcagacatgccgcagacaatactgatgatcagagggtataaaacggcaatcgcgctgaaaaagacgctgtacagcatataagactcctgaacccttccatacatatataacaggaaaaatcccgcgcataaaaccggcgccgcagcatgcatccatatgagcggcgtgcgcttcatttttaatacatcggcccacatatatcgtaaaagcacggtcatgaccggtttcccccttttgaaaaagacactgcggaaatcaaacttattgcgataaaagaaaggatagaaagaataatagccggaaagatcacgtttccgtttaataagccgctgtttgcgggaagcggaattccgttcgggtggatcccgagaatcggtgacatcagccggactgaccagctccacggactcagccaccacaatgaaccggacgccggcacaatgcctaaaacaaaggcggcgatcatattgatgagaatgactgccgtaaatccgaactgtctggcaatccataagcacaatgggatttcccaaagcgtcgtcagccacaaaagggagcttgcttcaatacctttcagctgaaccgcagcaattgccggaaacacaaggccaagcaaaaacacgatgactaaaaagacgatttgcgacaggagtgaatacagcgcgatcaaacttatttttgagaaccatatgctttttaaatctgccggcaatgagtacaccgcgcggtcattcgctgattttttctcttttttaacagataaaccgcacattagagcaatcatgagcggcatgaaaataaccgcccaccaattgaacgtgcccgtcataaaataggcggcattcagcagaaaagaaaaagccgcgttcagaagcggaatcagaatgatcagctttctgataaatgttctattagatgtaaggtgttccgcctgcatgtactgaatcattttcctgtccccgctttctcccgtgttgatttgacaacctccagaaacagccgctccagatcgtcttcccggctgatttctccctgatatcctaaaacgccgtcactgatgattccgatatggtctgcgatctgctcgacttctgataacaggtggcttgataaaataaccgtcattccctgtccgggcagggagcggataaattcccgcaaatcctgaatccccatcgggtccaatccatttgtcggctcgtcaagaattaagagcgacggacggtttaataatgctaacgcgatgccgagacgctgtttcattcccatggaaaattgtccggcgcgcttttttccggttcccgttaatcccgtgatttccagcacctccgcaattcttgaatcaggcagtccgagcatcacgcagcggactttcagattttcagcggctgtcaggttgctgtaaagcggcggtgcttcaatcagggaaccgatgcttttcaaatcttcgcgcttccatgtatgtccgtcgaacagaacctcgccggatgtttgctgcagcatgccggtcaatattttgagagtcgtcgattttcccgcaccgttcggaccgagcaggccgtatatactgttgcgtttaaccgatagagacacatcagccactgcctgttgtctgccgaatgatttttgcagctgtctcgtttctatgatgttgctcatatgattacccctctgctttgttatttgatatgtaagactttacagcgcagttatcaaaatttaatcaagaaatcaaaaaaagcatccttcacgcggaagaatgctttttttcatgaggctgagcgtacgatcagctttcttttttgttttttcacagggctgagggctcgttccagccacgccatcagcaggtctgcggccaccgccatcagcgcggtcggaatggcgcccgccagaataatggcggttccgtttgtcgcgttcgagcctctgacgatcatatccccgagaccgcctgcgccgacgaaagtgccgatcgccgtgatgccgatggcaatgacgagcgccgttcggagacccgccataatgacggaaagcgcaagcggcagctccaccatacgaaggatttggtatttcgtcatgcccatcgcttttcccgactcgagataagcgtgctcgatattgataatgcccgtgtgcgtatttctgagaatcggcagcagtgaatacaaaaacaaagccgtgatgaccgtattggcgccgagccccatgacaagcatcaggacggcgagcatcgcaagcgccggaacggtttgaatcacgttcgccacagcaaacacccagccggcgagacgcccgtgcctggctgtcacaattccggccggaatggcgaaaacggcggcgaaaacgacgccgtacgccgacatgagaaagtgccgccagcactcatacagaacatagctgccgttttgagcgtaatacgtaaacagctctttcatcgtgtccatccgcacatctcctttccgttattcaaagtaatgatgtttttctaaatattccttggccacgacggacggctcttttaatcggccgtcaacttcgtaattcattttctgcatcatcttcgtatcaatcgcgccgatcatttgattgatcacgacctccagttcgggatgctcttttaatacatgatccggaacgacaggtgaacagtcatacggaggaaagaaacgcttatcatccttcagcgttttcagtccgtaagcgatgattcttccgtcggtggaataagcgagcgcgatatccatctttctgcttttcagcgcgtcgtatacgaggccgatctgcattggatacgtgccttcaaatgacattccgtatgttttcataaaatcctgatatccgttgcctctcagcttcatccaatagttatctacgccgaatttcagatgagacgcttcttttttgacatcggataccgtttctaaatggtacttgcgggcaagctgtccggaaacggtaaagacgtatgtattatcaaagccgtaagaatcaaaccatttcatgtcatatctgttttgaaattcacgctgaacgagccgcagcgctttgtccgggtctttttccggctccatgcgaagcgtcccggtcagcgcgtctcctgtatagcgcgtcgcggcgatatcaatatcaccgttgatcaaggattgctgctgtacggcgttggagccgagatttttaataacggatgttttcaacccgctgtgatgttcgatcatctgtccgagcatgcttgcgatgatttccgattcggtcatgctttgcgcgccgattttaatggtgtcctccgatgcggcgctcaatcccgggagcgagcatccgccaaggagcagcatgccgagacaggcgattgcgagcagccgttttttgcatctattccccatgtgagacctcctccttataaagcgtcctttatgcttttcagcccgtcagacgtgactttccgttctgtcacccccagcatgtaatcgacggcggccgccagcatcgtgaccggaatggcgcctgcgataatatactccggctgataaaggttcaagccgataaaaatgtaatctcccagcccgcctccgccgataaaggaggcgagcgtcgcccagccgattaaataaatcgaagacgtcctgatgcccgccatgatgaccggggcggcaagcgggagctctacaagcctgatctgctcccatgccgtcatgccgattccttttcccgattccagaagatgccgattgacgccgagaatccccgtatacgtgtttctgagaatcggcagcatggaatagaaaaacagcgccgcaacggccgggacctttcctacgcctaaaagcggaataaaaaacgcaagaatggcaaggctcggcaaggtttgaatgatgttgacgatgccgatgacggcgccggctcctcttttcatcctcgtcagcaggacgccgagcggaacggcggcgagaatgcccgccatgacggcgattaatgagatgtacagatgctcccatgttttataaagcatctctcctccatttgcctgtaaaaattgtacggtctgattcatatcaattgaagcctcctcatgacatcaccgcgagctgattctcttctccccagatggagtcatagacgatgtcaacgaggcttgcccttgtcacgattcccgttagccggccgtcctcatcaaggaccggcacaaatttcacgcctctttttaaaattttatggacggcgtcgcgaagcagagtgccgcttctgaccgtgtacagatcccgttcaagcacttccgcgacggttaccgcttgtcttcgtttgcggtcaatcatctccacatcgacataaccttggagaacgttcttttcatcaatgacgagcagcgaatccacccgctcggcatgcatcagctgaatggcggctgacagtgttttctcaggtgttaccgtcacgggatcgggattcatgatctgctccacccgttcaatatcagggctggatgattgaatcagccgttccttgccgataaactcctcaacaaattcattcgccggaaatctgagaatctcatcaggcgttccggcctggacgatttctcccgctttcagaatgacgattctgtccgcaagcttgatggcttcgtccatatcatgggtaacaaatacgatggttttatgtaaggttttttgcagttttttaaattcttcctgaagggaatctctcgtaatcgggtcaagcgccccgaacggttcatccattaagataagcggcggctctgcggcaagtgcccgtaatacacctattcgctgctgctgtcctccgctcagttcatgagggtaacggtctaaatattcaggccccatatcaacgagctttaaaagctcccgcgcccgttccttccgtttttcggcagaatgctttaaaagcttcggaacgagcgtaatgttctgctgaatggtcatatgcggaaacagcccgatctgctggatgacatagccgatgcttcttctgagttccaccgggtcttgttccataatgtttcggccctctatcaggattctgccttctgtcggttcaattaagcggttgatcattttcatcgtcgtcgttttgccgcagccgctcggtccgataaaacaaataaattcgcctttgtcgatattcaggttgatgctgttgacggcttttttcccgcctttatacgttttcgagacattttctaatgtcagcaaacactcacacctccgatattaaatttgttcaaatcgttaaattcaaatttaacttttcagacaattgaacgtttcccattataaattaaactttgtaaattaaaaagtttacaatttgtccatattatatataaaggttgtgtaagcactgatttacccgtattgaccggcaaagttcttcttattgctccgaattactgccaaattctctcggaagagcatttccgccggtttaaaaatgtggtatattgacatcggaattgctgactgaaaggattgaaactgttggagaaagatccgttacacgtaatcgaacaagctgaagatcatttgatagaacgaatcgctgaaaatatgcatacattcggaatgcccgcgacggtggggcgcattttaggcattatttatatgaaccgcaagccgatgaccttaactgaattatcagaagcgaccggcatgagcaaaacgagaatgagccaggcggtccgtgaaatgcttgacgtcaatctggcggaaaaagtgtttgaaaaaggcgtccgcaaagatttatacgacgtcgagcaggattattaccaaacctttattacgctgtttacggccacatggagcaaggtcgtcagcaaaaataagatgatgcataaaaaactgaaccgcgaactgacggccgtccttgaaaacggcgtgccggaagaagctgaggaaaaaatcaacgaactgctgaaagaattaaaggattggcttgattactacaactggatcagccgtctgatcgagttttttgaaagcgaagaaatattcaagcatgttccgaagccataagaaaaaaaacgccctgacccgcaaggcgtttttttcatgccgcattcggcgctttggttcgttttttctttctcaccggactcagcgcccgctccagccatgccatcacaagatctgcgataacggccatcagcgctgtcggaatggcgccggctaaaataatcgctgttccgttcgtggcgtttgagcccctgacaatgatgtcaccgagtccgcccgcgccgacaaacgttccgattgccgtaatgccgatcgcgatgacaagggccgtccgcagccccgccatgatgacggaaagcgcaagcggcagttccaccatgcggagcacctgaaatttggtcatgcccatcgcttttcccgattctagataagcgtgttcaatgctggcgattcctgtgtacgtattccggatgatcggaagaagcgaatataaaaacagcgacaaaatcaccgtattggcgccgagccccatgacgagcatcagcaccgcaagcatcgcaagcgccggcacggtctgaataacgtttgtcaccgcgaatacccagccgcttaatgttctgtacctggcaatgaagatgccgagcgggacacctacgatcgccgcaaataaaacgccgtataccgacatgagaaaatggcggtaaaactcctgaagcacatagaccccgttttgagaataataagtgccgagctgctgcagcacttccatttgccccacctcatttcttattcaaaataatgatgtttctccaaaaattctttagcgacgacggacggttctttcagcttgccgtccacctcgtaattcaattcctgcatcgtttccgtatcgattttgccgatcagtttattcacaatgcccttcagttcaggatgctgcttcagcacgctgtcgggaatgaccggcgaacagtcatacggcgggaaaaactgcttgtcgtcttttaaaattttcagatcgtacgctttaatccgtccgtccgttgaataagcgaggacggcgtccattttcccgtttttcacggcatcgtatacaagtccgatctgcatcggataggttgtgccgaattcaaaaccgtacgtgtcggtgaagcccttatagccgtcgccttttcttttcagccacgcattgtctacaccgagcttaaattgatccgcatgcttcttaatatcggacactttgtctaaatgatctttttccgcaagctctttcgtgacggtaaaagcgtatgtgttctcaaatccgtaagaatcaaaccatttgtaatggaagcgtttctcaaattccttctggacgatagataatgcttttttcgggtctttttccgcttccatgccgagggtgctcgttaaatccgttcccgagtagcgcgtcgcggcgatatcgatttcaccgccgagcatcgcctgctgctggacatagttcgatccgaggtttttaattaatgccgtattcaagtctgtattgtgctcaatcatctgtgcgagcatattggcgataatttctgattccgtcatgctttgcgccccgattttaatcgtatcatcggaagccccgctcaggccgggaagggaacagccgcccagaagcagagcagctgacagcgccagtgcgcacatccatctcttttggtttcttttcaaaacagccaactccttatgatacttccttcagtcctttcagccctttcggcgtcaccttccgttccgtcgccgccagcagataatcaatgataatggctaaaatggtgacgggcacggcgccgccgataatatattcaggctgatagagattcaggccgataaaaatatagtctccgagcccgccgcccccgataaaggaagcaagcgtcgcccagccgatcagataaatggtggatgtgcggatgcccgccataatcaccggaaccgcaagcggcagttccacaagcctgatctgctcccagaccgtcatcccgatgccttttcccgattccagcagatttttgtttacgccttgaatgccggtatacgtgtttcggagaatcggcagcaccgaatagaaaaacagcgcgacgatcgcgggcacctttcccacgcctaacagcgggataaaaaacgccagtatcgcgagactcggcaaggtctgcacaatgttgacggcgccgatgacggcgcctgcgccctttttcattctcgtcagcgccactccgagcggaacggcgacgacaatgcctaatatgacggcgatgatcgaaatgtataaatgctcccacgttttatataacagttctccgccgttcgtctgcaaaaacttgatcatttcattcattgtaagcgttcctccccttgtcagcctgtcaccagctggtcttcctcgccccagattgaatcgtaaacgatgtcgacaaggctcgcccgcgtgacaattccgactaaatgcctttgtccatcaacgacgggtacatatttcattccgcgctttaaaattttgcgtacggtatcacgcagcagtgtaccctgctcgaccgtatacagatcagagcggagcacgtcgccgacgaggctcgcttttttccggttctgatcaatgatctcgacatcgacatacccttgcagcacattcaggtcatcaacgacaagcagggaatcgacacggtgctcccgcatcacttggatcgcctgcgaaagtgttttgtccgccgtaacggtgacaggctttttgctcatcatctgctcgacgcgctcaatgtccggtcttgattgcaataaccgttctttgccgataaattcttcgacaaactcattagccggattccggagaatgtcatcaggagtgccggcctgaacgatctctcccgcttttaaaatgacgatccggtcagccagcttaatcgcttcatccatatcgtgggttacaaacacaatcgttttattcaatgttctttgcagttttttgaattcttcctgaagggaatcccgtgtaatcgggtcaagcgctccgaacggttcatccataagaataagaggcggttccgctgcaagggcgcgcagcacgccgattctctgctgctgtcccccgctcagctcgtgaggatagcggtctaaatattccgggcccatatcgacgagcttcaaaagctcccgcgcccgttccttccgcttttgttccggccatttcagcagtttcggcacgagagaaatgttctgctgaatggtcatatgagggaaaagtccgatctgctgaatgacgtagccgattttccgtctcagctccaccgggtcctgctccataatgttttcgccatcgataaaaatctttccggatgacggctcaatcagtctgttaatcattttcatcgtcgtcgtttttccgcagccgctcggcccgataaaacaaataaactcgcctttttcgatatttaaatcaatgctgttgacagctttttttccgcctttatagactttcgatacattttctaatctcagcaatccgtgcacctccgaagggttccgttatttttctgaaaagtataatctttattataagatgaaatttgtaaaaaaaaaagtttacaatgtgttgaaattatatacaatatacgtattttttcatgttatcccgctgacaatgcggatgttcttacaatcgctcccgatagctcgcatatcctgccgcatcatctttttcatcaactgtaaaaaatatgatatattgtcagcatgaaaagccagtgaagggatgatcagccgtggaaaaaaacgctcttgatatcatcgggcatgctgaagagcatctcattgagagaatcgccgagaatatgcatacattcggaatgccggccacacttggtcgtgtgctcggtattatttatatgaaccgcaagccgatgacgttaaatgagctgtcagaggcaaccgggatgagcaaaacgaggatgagccaggtggtccgtgaaatgactgatgccaatctggcggaaaaagtgtttgaaaaaggcgttcgcaaagacctttacgacgtggagcgtgattattaccagacgtttatctccctgtttacggcaaattggacaaaggcggtcagcaaaaacaaaatgctctataaaaagctgaaccgcgagctgactgagcttctggaatcggaaaatctcagtcccaatattgaagaaaaagcccgtcagcttttggatgaactgacggattggctccattattatgactggctgagccgtttgatagaattttttgagagtgaagaagtgtttcagcatgtgccgaaaatagaaaaaagcagcccccgaagataaccgggcgctgcttttttaagtcaggaaaccaatatcggaaacatgcctttcagaccggcgccgatcatgccgatcgccaccaccgccaaaatcagccccatcagtcgggtaatgacgttcatttcggttttcccgagcttattgctgatgaaagaagaatagtgaaagaagatgaacgtcatcgcgatgacggccgcaatgccgataagcacgctgatgtaatggatgatgccgccatggccggccgacagactcatcaccgtcgcgatcgtaccgggtccggcgataatcggaatcgacaaaggcgtcacggatatatcggctttctccttgctctcccctttctcttcatgatggagagactgtacatgagatttcttcgcgttcagaagattataagcgatgccgaaaataaaaatgccgcccgcgatacgcaaggcatgaatgttaatgtcgaacagtttaaagatcagatggccgaagattaaaaaagcagccaagatgataaacgacagcacggaagccttgcgtgcgatcgctgtccgttctttctccgggtatccttccgtcagtgaaagaaaaatcggcacgtttccgatgggattggagactgcaaacagtgaaatgaagacatgaatgatgaatgaaaacatgcgtacctccttatgacttgccgttattgagttatgttttgttctccgctgtttcttatgcatgatttttaccccggggtctgctttttataacctcagccggacgatccggaaaacagaaaaaaccgtccttgtaaggacggttttttctgtttgctatctccataagccttttccgaatttcaacagccgataaagcattttcaatttttttagcatgcgttaatttcctttttcactctgaatcaatgcgccgagagacatgatatctatcagctccaataaaattctaccataatgggtactttttctctattatcaattcatagagaaggtgatttatatatctttagaaaactccgttacatccgtcctactttcttttataatgtaaatattgaacaaaatccctatattacttgtaaaaggagttttagaatgtattgttctcaatgcggccatcatactgatggcggaaaattttgtgaaaagtgcggtgcgccccagcccgggcagggaggcgcaggccaaacacagggtcaggccgctcaggccggcgccgcggctaagcaggcttcaaagcaatttgccttattcgtgcttgatgtgttaaagagaccgtatcaaacatgtaaaacgacaggcggcgaacagcttgtcagcagcatcatcaacatggtgcttttctgcctggtgacgccgattatgttttatattctcttatcagacggctttcgtgacgtcagttttaccgcggttgtgatcaaaccggcgcttacctttgcattatgcgttttctgcctgtatctcttgatttttatcgctttgaaggccggcggcgcgcaggtgtcatttaaagattcgctgtccagattcggagcatttttgattccgtttacagctattttgcttcttgccctcatttttatgctgcttcatacaaccgtttgctttaccattctggctgtcggtcttttaggagcggcgtttgccgtgcctccgctcatgctggcgagctatcagcatcagctcactactaaggcggatatcatttattctgttatcgtcatctatttgatcatttgcgtaacgtttcaattcacgatcaagcattatatgaaagaactcatgaattatttcttcttttaaaaacggaaacccccgccgcctgattggcgcgggggtttttttattgaatggatgttaaataaattcttccgtctttgacaacgccgccatacgtccaattgtatgttctgagcttcggactgccgccggctttcgtaatataaaactcctcgtacgtatgaatcgtcagatgagagcctttctgtgaaaagcttttgacattcactttattaaatacttcagtcgtcccctcgctgtacagttttttgaccagtttctgctgatcagcatacaaagggcttccctcttctaaattgcccgccatgatggcaaaattgttaaggctgacggcgcttgattgatttgtcaggtaatcagtcataaacgatgtgacttgctcgtttgtcacgctgcctgaagctgtatttcctttggaagatgcccatgcggatgtataggttttcggctggtcgttttttattttttttacatttgtcccagaagaatctgaggctggatcagctttttcaaaaacccattttttatgttttgtatcatatgagagtacataatgaaagctcggctcagcctcttccatatcaggcttcgtattcccgtcgaaataagcagactcatgaagctctttacccgtaacagttacttgccagcggccgttctcttgagaaatcgcaaatgaatccagatcaaagcttgtctctttatactgatctttcaaaaaggtgccggaactcttcatgccggataccacttctttcgtctgctctttccaggcggaaccagcctcggtcatctgatcggtatttccgtctgccatcgcttttgtatactgcttcgttgttttgacaatcgtgtccatgattgtttgttgtgtatcttgatccgggataagcgttaattccatatcagtaccgttgatcggaacatcggcagttttcatttttccccaaggaaaatcagcctccacggcggctgtcatggaaccgtcagttaagagcggaccgtatgtaacggatgtaaacggatctttatggacggacttgccgtttatcagcagatcgcctttcgcgcttttgaagctgtctgccggagtgaacgtcacatcctcggcgtctaacggcagatcaaaatcaacattccggctgccggccgcctctgcctcttgctttttgacaacgtcaaccgtgtcatttttaagcttggcttccgccgtgtagacaccgggtgcatacgggccgaagatttgggtttcatcggcttttttgaccgtccctgttttctcgctgttgatataaagatcggcgcctttataattgctggtaacgcggaaataaaccggatcgactttcagttcgtaatggtcaaacaaaagaagggttttaccctcttttttgacgtataccgcatctttttctgatgaattgccgcgaagcgtttccagcagttcatcgtgtttctttgcgtatgcaaggagcggtttgacattggtctcattcagcttcagttttttgtctgaaggagtgagcagggctgcgagctttttcgtgtccccgtcatgaaccgcctgttcgaattgatccgtgagccttttttcagatgtcagccaggctccggttttatatgcggcaatcaataagatcagcgctgcggctatgccgccccatatgaagagcgtttttttagggatcggctttctcatttgtgaagcaggttcagccgctcttacagccgcctgccgttcaagccggcttcctttcccgatcggttttccgcattctttacagaaatgcgcctcttcgttgttctgtcggccgcaatacttacaaaaaaacatgactttcctcctattcaatctacaaaacttgtataacttttcctatgtttcatattttataataaagtagaatgattttggagttattttgaaaaatagctgtcgatcataacggaggaggagaaacggacatgcaaaaactgagcatccgaaaagccgcggatccggatgaagcgctgtatgaactattgctgctggccgatccgtcgaaagagattgtcgatgattatcttgtaagaggagaatgctatacggcttggacgtcagacgagcttgcaggggtttacgttttattgcaaacaaggcctaaaacgatagaaatcgtaaacatcgcggtaaaagaatcgctgcagaacaggggattcggaaaacagctggtgcaagatgccattgaaaaagcgagacaatcgggagctgacacgattgaaatcggcaccggaaattccagtattcatcagctgtcactctatcaaaaatgcggattccgcattcaggctgtcgaccatgatttttttatcagacattatgatgaagacatttttgaaaacggcattcaatgccgggatatgatacggctttatttggatttatgataaaaagggcgccggctgataccggcgccccttcgtttaccattcagacggattgatccgcttgtttctctgaatttctttgactcccttgtctgactgaaaaaacagcaaaaacgatcgtaagggtcagtccgaccgccgcaaaaatataatccgcattcatcaacagcagaagccctgtgtagacagcggcagacagcggttcacccattttgacaatggaaaaaatcagtgcaaaaacccttccgaaatatgcggccggaaccgtcttttggaaatacagcaccgtttgcacatcaatatacgagatgatgatgccaagcaccaggaaaatgatgcactcaaacccgtgaagcggaaaaaacagcaccaaaatgagcagtcccgctgccgttaacgtccgcggatacagccggttcaagcgttttgtattccatttgaaaaatacggccagattgcccaaaagcatccccgcctgaaacattgaatacatgacggcaaaccatacagaatagttctgctgaaaacgttccacagcaagaatcggccccattactgaaataagaccggcaatgacgagatttacgacgaaaaagtatccgaccgatgtcagccatgccgcatttcctttcagcattctgtagccggcttttacatcttcagccccgttgcttttttcattgggctgttctgaaatacgaatgaacgcgataaatgccgcggagataaaaaaagcagttccgtttatggcaaacagcagcccgaacggaatagccgcaatcatgattccgctgatcagttttccgacgatgagtccgatcaagtcactcgtattgatcagagatgtcgcctgatcaagatgctgtttgcggacgagcagcggaatgatcgcgactttcgccggcgcaaacagcatcgattgcagagatagacaaaaggcgcacacccctgctatccacacggttaataaatcgttcgcgctgagcaccgccaagaggatcatgatgacggcccggcccgtattgcacaaatacaagatcgacttttttcggaataaatcaatcagcggtcccgccagcacgccaaatgtcaacggcacgagttcgataaaagaaataacgccgacaagaattttactgccggtcaattccagcactaacagcggcagtgcaataagccagataccgtccgccgctgaagaaaacacctgcgcacaccaaagctttgcatagttcggtgttcgatatgtcatatcaggcccttttttgatcctcggcatcagaaacaccgccgaaccattccagcgttctccatgattcccgtctttcggtataatcctcttccatcacctcaaatacaatgccggtatcttgattccgataaagctcctgcaaagtatcggcagcccgtctcagcagctcctcagcgatcgtcccttcactcggatggcggccctcaaaacagcggacgccgccatgcgggaacgcaagctggcgaaatgagctgaagtgataatgtttaatgctctcttttatcgagagaaactgaaagaaatccgggtatctcagctggtcatttctgaacataagcgcggaagacaagtgagtctgataggtaatcgcccaatggcacagatcccacgtaataccgacatgcttcagatccagctgaaccagctctgtaaaatcctcaggataaatgaaaatcggatcaaaatcctctcccagattcccgatgatcggaaggttttccacaccgatccaaatgtccgtccctttcagctgctcatcaaactctgcgaaaaactcaatgatttttttacggtttccttccaggtcatacacttgaaattcctcaaccgtcataaattgattcgcatgaacggttatgcctttggcgccgtatttcacagcgagctccgcaaagtgataaagctgttttttgatgtgatcttcatgcacataatcggcatgatctgtcgggaaatgcagcgtcaataatgaaggatcaagctgttttgcatattccagcgtctgattgaatgttttgagataatccgcttcactaaaggagcggccgtcaaaaatattcgcttccagaccgtatcccgcttccacccatttctcatcgatttgcttcggatcaagtccgaaaaacggaatttgagcaatcataggacagtcaccatgttcctctcacaagcataaacgcttccgcagcggaaaaacccgattttgctccccatacacgggcattatgttcgattgcctgcaaagagcggggatgagggaagtctctgagctcggagccgtaacacgccatcgatttcaattttgtttcaagctcgtcttcaatattaacgaagaaattggcatgaaactgatccttctgacagtaattccattccgtcgaagacaatgtttcataggcaaaaacccgttttaccgtatggccgggaagcggacgggttgcggtcatgaccgctctgaatacgacggagtggtcaatattaatgtcaccgccgtactgggtatacacaatgtcaggctgaaaacgattgatttgtttctccgcttccttcacgacatccagcaaatccattgaatccattctgttatcaggaaggttcagcctgacaaaatcatggatgcccaaagtgctgagcgcttgttccgtttcttgagcagaatgctgcataacagactcttcaggcttctcataatccgtttttcttgatgacttgccttccgccataatgactgccgacacgctgtcaccttggcggacatgtttggcgagcgtgccgccgacgccgataatttcatcgtcgggatgcgctgcaaataccattactttcatcatattgccctcctttaactaacatttcagctgtatccgctccgcagttcatcagcatatcaagcatggagaggtgagggatatgctccccgaataattgaggatagtcaaaatgccggatctgctgatactcaatgacaattccgtttctttcaaaatcgctttctattaaatagtcggaaccctgactgcctgaataataacgatccgcccccagctcctgacaaagcgctaaaacaaaatcgctttttttctccttccggcattcaagctcagagacataacagagcggcgtttcgattcggagctcttttcggaaaaattcaatgatgtgcatattcaaatcatggagatattcccactccctctgatagacatcttgaaaaaaatgctggtaccgctcaaaatagggagctttcgcatagttcatcttaatcgccatccaatgttttttccgccaatcctgtgtctggtcgattttcatatgccgaagctctatgtctttatattgtttcatctgcaaaggcaccgtcagccatctggggccctgcggcgttttgattctgttgcggttcagaaacccttttttctcaaattgagccgtgtcatgaatggcaaacagatccgacttatacattttttcaaaaaaaccgtaccacggcagataactggattgatggccgcttattgttttcattccggtttcgtaaaaagtcggcattgtttttcttcagctccccaatatcgtttcggtcttgcgatttctttactgtgtgaatagccaaaatcagcccattgaagcttgcggcaaatggcgaattgcaaagcgtcacgcatcaacaagtaagaggcctgcgctttttttcccgcaaggctgtttacattctgccaataatagaaatgagagcggtcatagagaaaaatactgctgctgatcagcgtctcatcctgatatgctccgacccaaaacatccggtccccaaacgtgtcaagcagtttttggaaaaatccttggctcagcacataagcagcgccgattgccgccgtatgctccttgtagaggtcgtaaaatgattcaagttcttgtcgcccgatcagcctggtgacaatattctctttttcagcgtatctgactgccgtccgggcttttccggaaatgcccgtccaaagttcgtcaaacgtgtccggaagcgtaagaatccgtgtcgccttttccgtccacccttccccgatttcttctgtaaaagaagtctgaccgtacggcagcagcatccgggatatgttccggccgaatatggcctcgatttcactttgaagccattcaaatgagatggggcgatctgaaataacgccgccgtatccgatcatattgccggataatacgcccttctgttcaaaaagcggaagatagatgacctgtcctccgtccgttgtcagtctgacagggtgaaatgacgtgccgggaagctcttccatgagaattccccaatcatagctttgaaacaaccccgcctgatacatgtcagcggcccgatcccatgcctggcggctcgtgcatactgctgttttttgcattgttatcaccactattcagtcttattcttttgctcacaatatgataaaacggattcggctatatatctgacttgctccttttgaagaggaggtttaaacggcagagaaagaactcttttccaaagcggatcttccccttcttccgccgcatatgtttcataaatcggaatacgtccgaggggaagatagttccagcatgtttggatgcctctttcagctaaataaacggaacacccgtaccgctcttcatcccgggggaatacaatcgttaaataattcagatgttctccttcttggggctggatcatctttatgccgtacgtctcttccgcctttataaagatttctcccgccgcttgtaagtttcggagcgaagctgttacaagctgatccatacgtgaaagctgatcttcaataatggcttcccttgccggatgcatgcgaagcaccggtacaacagccggtttatccggcagagcttcgagcttagtggctttcatggaaggcatgacgcccgctttcctataaatatatgaaacgggatgatgccgtttccgtttcataacagcctgtattctttgatttctgatataaattcgatagtcagctgccacttggctgcgctgttccatcgggaaatttgctttttgccgaagccattctttcggcgcgattaacgcgccgcctccgatactcgcaagcggttttgacgggccgaagcttaaaacaccgaaatcgcccagaccgccggcatatgtatccgcttgttttgtaaacatggcttgagcggcatcatcaatgacaaaaataccgtgttccttcgcccagtcaatgatggcggtattttctctccggccgtatacgtgcgtgaggataaccgcacacgtctgccgcgtcgctctttttttgacatcctcaaacgataaagaaagatgctcatccagctgcgcaaaaacaggcgttgcaccggattgcaatacggcatcaatgacattcgggcagctgaaggatgagaaaatcacttctttccccggcccggctcccgaataagttaaggcgagcaccagtgccgcactgccgctggaggtcagcacaaccccttttccgtaccgtttttccagtttttcagtcagtccgctttgtccgccagtaagcaagtgcttcaccgcgcgcagacggcccctgacggaaagctgtccgggataaacgggatatttgactacttccgggttttcaggaaagtgaaagtttgtgcttttgtctttcatcttttatgatctccaggccttcattcagacttacttttggagcgtaaccgagtaaacgtttcgccttctcgattgacggcgcccgtttaaaaatctcgatgtcttttcccctcacgccgtcttcgcccagctttttaaacagatagttatccttctctctgccagagagcacattgactttttcagccagttcttttatcgtgatcggctggtcgtttccgatattgaagtcttcaaagactgctccttcatgaatgagcgcgagataagttccgatgacgatatcactgatgtagctgaagcagcgtatttgtccgccgtccccgtaaagaggcagctcagagccattctcggccaggctgaaaaacttgttgatgacaaaatcctcgcgctgtttcggcccgtatacattaaagtaccggacgacccgaatatgaagcttgtcggaagcctgttctctcaaatattcctctgattgcagtttggcttttccgtaagccgatttcggaagctttctgcttgtctcggtataaggaaaatcaggtgaatctccgaatacttctgagctcgatgagaaaagaagtgttctgattcccaattcaccgcatacctcggtgacatttttcgttccttcaaaattaacccgtatgacgtcttcttcattgcttcggcagctgtctacaccgaccattgccgccaaatggacaaccgcatccgctccccgcagtgattcgcggagggacgtccgatcaaggatatccgtttggcggtattcagtgtcaaaagccggctccttttggtctgcaataatggtgtgataacctttagcctgtaataatgccgccaattcgcttccgataaaaccggctcctccgataatcgcaatatgtttcatgatcctacctcctggctgatagtcaaaacttcttttatagacttgacaatatagctgcaatcctcatctgataactggctgtaaagaggcagtgacacgatctcccggaaaacacgttcagtaaccggaagctcggccggaaaatgtttttgatagtaaggatgcatatgcacgggaataaagtgcacgctcagcccgatctgtttttctttcattttctcaataaacagatctctgtccatgccgccgttctctcggatccgcaaaataaataaatgccatgagtgcgttatgccgttcggaatgtcagaaagcggaagcgctgctttgtcagattggcccgacagttcacgtacataaaattgagcgatctgtgcccgtttttcttgtatttcgtttgcgcgcttcaattgaaccagaccgagcgcggcctgaatatccgtcatattatatttaaagcccggcagtaacacgtcgtatctccagctgcctttttcaccgtaccggttccaggcattttttgtgatgccgtgccagccgtacagcctcgctctttctgcggcctgttcgtctttcatgacgagggctccgccttcccccgttgtaatatttttggtggcataaaagctgaagcacacggcatcaccgtgagtgccgatcatgcttccgttatattttgtaccgagcgcatgagcggcgtcttcaatcagatacaatccgttttctttacaaatggactgcaagttttccagatcagccggatagccggcaaaatgaaccgcaattaccgcttttgtgcgcggcgttattttcttcctgacatcttcaggatcggcacatagacttttctcgcatatatccgcaaacaccggaacggctccggcgtgcaggatgacattgacgctggaacagaacgtgaagctcggcacgatgacttcatcgccttctcccacaccgagcgccaataaagccatgtgtaatgcagcggttcctgaattacagctgatgacgtgttcggctccaatacattctcccagctttttttcaaaatcgattaccttcgggcctttcgaaatccagcccgactgaatcgtttcggttacgcttgcgatttcttcgtttgtcatatcaggtctgtgaaaagagataaatcgattactaatgaccgttccctcctataaagtgacaactctgcaattgtcggctgatttttccctgcatacatttcttgtgtcaaagataatcggtgaggcatccttcaaaatactgtagtcgattacatcgtgatctgtatgaatgatgatgacgtcgtactgattgatttgttcttttgtgaaagggacagattgtttgcggcttccgtcattcaagcggatctcgctgataaacggatcatgataatcaatcgcgcatcccttgtccatcaattcttccattatcgtaaacactgaggattcacgcgggtcatttgtattttttttataagcggcccctattattaagatgctgcatttgtctttgcccgccagtttcaaagcatagtcagagacagaaatcggcatgttagaattgatttcgtccgccagatcaattaattttgtctgcagccctttttcattcgcgatccatttgaagtaaaaaggatcaatcgggatacaatggcctccgactccggggccagggataaatttttgaaagccgaacggcttcgtgtccgccgcgcagatgacttcccatatatcaatatcaagttcacggcaattaagcgccatttcattgataagagctatattgacataacgataagtattctctaggagtttagctgtttcagctacttcgggtgaggtgaccgggtgaatgcttgtaacaatggtgttgtaaaacgctgaggcaagttctgtgcaagtctgtgtggttccgccgactactttaggaatatctgaaacttcatattgcctgttgcccggatcgattctttccggagaataagccgtaaaaaagtctgttcctattttcatgccgcggcttgatgccattctgtcggcaatcttttttttcgttgttccgggataggtggtgctttctaaaattaaaagctgatgctgccttccataagcgatcatgctgtcaactgcactgtcgatgtaggttaaatcggggatcttgtcttttttgttcaggggtgtcggcacacatatcacaatgatgtcgcatttttggatgagcgacatgtcggcactgatttgaaagcgttttgtttgtaaagccgagttcagtctgccgtcctctatatcttgaatatggctgcttccggcggctaacaaggaaaccttttcactgtttttgtcaaatccgataacattgtatcctttatcgacacattccagtgcaagaggaaatcccacatatcccatgcctaacacgcctactatcgcctgcttcgtttcaatcagatgtaacagccgtttttgaccaaggttgctggcttcttttgtgacagtattcatttttcgccccctaatagatagaaaagagtattgttttttacaatttaaaacaaatatcgatcgatatcgcaattataacaaaagttaaaatttgataaatgagttttacatccttttgtgaattaggtattatctatttatttttcttttatttgtaaaataaaatcctgttaaatggtatatatctggtaacgagtgagaaaatctcccttaattgatagaatatacagaaaataatataaaaaaacaggccgaagcctgttttttattctttcattgcctcagttaccgccgcggaaacgagtgccccagctttctctagccgttctttgctgatgtgtttcatattatcattttcggtgtggtaccagggccccggctcctgtgtatcggggctgagccaaatccagttagccgacggaatccccgcttcataaaaagagacatggtctgagtaaccgagctgaatcaggtttggcttgaccaaccgggatttttcagcggctttttcagcataccggacactcgggttttccctgccgtcaggagtcgtgacacacatttgactcgcttcttcccagtcagtcgcaatcatatcggcattaaaattggcccggctgtgctttctttcattgttcgtgagtgtactgacgtaataagatgaacccgcagaccataattcttctgcaccgaacaggataaagcggatctctttgtctttcggtatatgtttgagttgcttgctgatttccagaacggcagatgtgcctgaggcgttatcatccgctccgggcgcgccttttacgctgtcataatgcgctgtgacataaataatatcagcatcagaagagttggcctgtgccgctttgcgcgttcctataatattttgtgagatgcggtttttatagtttttaaattgaatgactgccttcttttcctgcagcaatgcttcaccgtcttcttttttcatacccgccgccggtatcgtgattcctttatcggtatgcggacggacggcgagcggttttgttgtctgattataaataatgactgctttggctcccgcttgttcggcatgtttgatcttttgagaaacggggatctttccttcgcgtatcactgcaatctttcctttggctcctgttacgtcattgcgtgatccgcagccgccgtcaaaaatcccgccttctattttgagctctttttcaacagcggattgatcagcggagcggagcgggaattcatgatctcccgctgtgactgaacctgaaaagtactttttcaatggaaatgactgtactttgacactggcgccctgagcccgcagacgattcgatatgtattcagccgcttccttttctttcgcagttccggtttcccgcggaccgatggtttcactcagatcatgcatagtgtccaatgcctcatcagcatcaaaaaccggcgcggtcacagttgaataagcatgagtttcggacagcggcccggcagacgcgccccatatgacgcttgctgccaccgcggctgacataaatgaaaatttcatcataatccctcctcttattaacacctcttccctttcgattgaagaacactgattcctttaaaaaggggaaaaatgaatattattgaccaaatgaagatgatgaaaaaggagggaaaagcccgggaccataaaaaacgccgggagatattctcccggcgtccattacattacttatttaagttatagaaagagttgataccgtggtattgagcagtttcagccaactgatcttcgatgcgaagaagctggttgtatttcgcaacacggtccgtacgggacggagcacctgttttgatttgtcctgcattagttgccacagcgatgtcagcgattgtgctgtcttcagtttcaccggaacggtgagagataacggcagtgtagcctgcgcgtttcgccatttcgatcgcatcgaatgtttcagtcaatgtaccgatttggtttactttgatcaggatagagttgcctacgccgtttttgataccttcagcaagctttttcgtgtttgtaacgaaaaggtcgtcaccgacaagctgaacttttttgccaagacgctctgtaagaagtttgtggccttcccagtcgttctcgtcaagtccgtcttcgatagagatgattgggtatttagaaaccatttcttcgtaccagtcaaccatttcagcagatgttttcacaacgccttcgccagacagatggtatttgccgtcttctttgttgtagaactcagaagatgcagcatccatagcaagcttcacttcttcgccaggtttgaagccggctttttcgattgcttcaacgattgtttgaagcgcttcttcgttagaaccaaggttcggagcgaatccgccttcgtcacctacagctgtgttcattcctttagcagaaagaactgatttcaggctgtggaagatttgagcgcccatgcgaagcgcttcacggaagttaggcgcgcctacaggcataatcatgaattcttgaatgtctacgttgttgtcagcatgctctccgccgtttacgatgttcatcatcggtacaggaagcgtttttgagttgaatcctccaaggtattggtaaagaggaatctgtaagaaatcagcagctgcgcgcgcacaagccatagatacgccaaggattgcgttcgcaccgagtttgcctttgttttcagtaccgtcaagctcgattaaaagctgatcgattgcgttttgttcagttacgtcaaagccgagaagctctggagcaatgatttcgtttacgttgttaacagcagttaacacgccttttccaaggtaacggtctttgtcgccgtcacgaagctcaaccgcttcgtattcacctgtagaagctccgctgggcactaatgcgcggccgaaagctcctgtttctgtatatacttcaacttcaactgtcgggttgccgcgggagtcaaggacttcgcgtgcataaacatcaacaatgtatggcatgagtttgtctctccttttgatttacgcttatttttgaattaaagatgttccggtcatttctttcggtttttcaacaccgagaaggtctaataacgttggtgcgaggtcgcctaggattccgccttcgcgcagcgtcacgccttctttcgtcacaatgacagggactgggtttgtcgtatgggcagtgtgcggttcgcctgtttctgtaatcagaatgtccgcattaccgtgatcagcggtaatgatggcatgtccgcctttagcgataatggcgtcaaccacttcgcctaagcattcgtccactgcttcaattgctttaatcgtcggttcgaccattccggagtggccgaccatgtcagggtttgcaaagttcaggatgatcgcgtcgtgcttgtcagccgcgatttcttttacaagagcatccttcacttcatacgcgctcatttcaggcttcaggtcatatgtcgcgaccttcggcgagttaatgaggatgcgctcttcgcccgggaattcttcttcgcggccgccgctcataaagaacgtaacgtgcggatacttttcagtttctgcaatgcgaagctgttttaacccgtgctgtgctaatacttcaccgaccgtattgtcaaggtttaccggtttaaaagccacatatccgtcaacagattcactgaagtgagtcaggcagacgaaatacaggtttttcggatgattttcaccgcggtcgaaatcgcggaaatctttgttggtaaacgtgtttgaaatctggatggcgcggtctggtctgaaattatagaaaatcacagaatcgccgtcatgaattttcgcgacgggttcaccgttttcttttgtgatgacggacggaatgacgaattcatcatgaatgccgttcgcataagaatcgtcgactacatccatcgcgctgcggtaagacgggccttcgccgtaagccattgcgcggtacgctttttccacacggtcccagcgtttgtcgcggtccatggagtagtagcgtccggaaatgctggcgatttcgccgacaccgatttcttcgatctgctcattcagctgctgaatgtaagttttcgccgtttgcggacctacatcgcggccgtcgaggaaaccgtgaatatacaccttcgtcagtccttcacttttcgcaagtttcagcagcgcgaataaatgattgatgtgactgtgtacgcctccgtcagaaagaaggccgaacaggtgcagcgctttgtcgttgtctttcgcgtttttgatggcgtcaaggaacgtttgattgcgttcgaattcgccttcgcggatggcaacgttcacgcgtgttaagctttggtacacaatacgtccggcgccgatatttaaatgaccgacttcagagttccccatctgtccttcaggcagtccgactgcttcgcctgatgccgtcagcgtctgatgagggtattggttccaataacggtcgaaattcggttttttcgcttgtgcgactgcgtttccgactgtttcattgcgtaatccgaacccatcaagaatgatgagtgcagctggttttttactcatattgaccttcctccaataattgaacgaatgactgcggttcaaggcttgcgccgccgaccaaagcaccgtcaatatcggactctgccatatattctttaatatttgcaggttttacgctgccgccgtattgaatgcggagcttgtcagcagtttcctggctgaagctttcagcaacgactttacggatatgcgcgcagacgtcatttgcatctttcgctgtagaagatttgcctgttccgattgcccagattggctcgtacgcaataacggaagcagcaacttgctcttcagaaagacccgcaagcccttttttcacttgatcggcaacaagatcatttgtttttccggcttcgcgctcttcaagcgtttcacctacgcaaatgatcggcacaatgccgtgtttaaaagcggcatgcgcttttttgttaactgtttcatcagtttcagcgaacatttcacggcgctcagagtgtccgatgacgcagtaatccacgccaaggtctttcagagcgaccgggctgatttcacctgtgaacgcaccgttttcttcaaaatgcatgttttgggcgccgactttcaggtcagttcctttaacagcagaagtcagcttttctaagaaaagagctggtgcgcaaacaacggcttccgctttgtctgctgctggaatggaagatttcacttcttcaacgaagctgacagcttcgccgagtgttttgttcattttccagttaccggctataattggttttctcatctgttccacttccttatagcagtttttatttatcgttcagcgcagctacacccggaagctctttgccttccatgaattcaagggatgcgccgccgcctgttgagatatggctcattttgtcagcaaggccgaatttttcaacggctgccgcagagtctcctccgccgatgacagagtatgtatcgtttgcctctgccaatgcttcagccactgcttttgtgccttgagcgaacaagtcgatttcgaatacgcccataggtccgttccatacgacaagtttgctgtttttgataacttcagcgtacgtttcgcgggttttcgttccgatgtcgatcgcttctaaatcacttgggatctcagagatcggcacgatttgaacgtttgcatcgttagagaaatcatcagcaacgagaacgtcttccggcatatagaatttaacgcctttttctttcgcgcggtccatgaatgattttgcaagttcgattttatcttcttcaagaagagatttaccgacttcatagccaagcgcttttacgaatgtgtaagcaagacctccgccgatgatcaggttgtccactttatcaagcagactttcgattacgccgattttgtcttttactttcgcgccgccgatgattgccgtaaacgggcgctcaggatttgtcacggctttgccgagaacgtcaagctctttttccatcaggaatcctgcaaccgccggcagatgctcggcaattccggctgtagatgcgtgagcacggtgggcagcaccgaatgcgtcattgacatatacatccgcaagctcagcaaatgctttagcaagctcaggatcgtttttctcttcaccagggtagaaacgtacgttttccaatacaagaacgtctccgtccttcatatcagaaatttgtgcttttacagcatcgccgtaagcttcatccgcttttttcacttcttttccgagcagttcgcctaagcgtgcagcgacaggagttaaacgaagctcctcaaccacttcgcctttcgggcggcctaagtggctcgcaagaagaactttcgcgccttggtctgcaaggtgtttgattgttggaagcgcagctcggatacgagtatcgtctgttacttccccgtctttcattggaacgttaaagtcaacgcggcagaatacgactttgccttttacgtcgatgtcttttactgtttttttattcatgccttaggagatcctccttcaaaatggtttgcatagcacgaaaaacgtgaaacgtgaaaccgcctcatgatgcttccgccgcggggcagattgcagcttccgggcacggggcagatcgtcttctgagccagggcaggcggctcagaaaacgaaagtgccgcggaaacttcaaaacgcggacgttctgcagcaatccggcgctttctgaaagccggttctcatggaaaaagggaaagggagtccgtccccttcccttgtccgctttcattatagcgtttctgtccgaaagaaccaagtccggccctttccgggagctatgaattaaagaccttgttttgcgatgtaagctgcaaggtcaacaacgcggttagagtagccgctttcgttatcgtaccaagagattacttttaccatgctgccttccataaccattgtagaaagagcatcgattgtagaagagttagcattgccgttgtagtctccggatactaatggctcttcgctgtagccgaggattcctttaagatcgccttcagccgcttctttaagagctgcgtttacgtcttcagccgttacgtctttgttaagttcagcaactaggtcaacaagagaaacgtttggagtcggcacacgcatagctccgccgttcagtttgcctttcagttcaggaagaacaagggaaactgctttagcagcaccagttgatgtaggaatgatgttttcagctgctgcacgcgcacgacggtagtctttgtgcggaagatcaagaatttgctgatcgtttgtgtaagagtgaacagttgtcatcataccgcgtttgatgccgaatttgtcgttaagtacttttgcaaacggcgcaaggcagtttgttgtgcaagatgcgttagagataacatggtggttagccgcatcgtatttgtcttcgttaacacccataacgattgtgatatcttcttcgttagcaggtgcagagatgataacttttttcgcgcctgcttctaagtgtttcgcagcgtctgcgcgttttgtgaagaaaccagtagattcaactacgatttcaacgccttgtttgccccagctgagtttcgcaggatcgcgctcagcagaaacttcgattgttttgccgttaacaacaaggttgctgccgtcaactttaacttctgcatctaattttccgtgtacggaatcatattgtaaaagatgagcaagcatgttagcgtctgttaaatcgttaactgctactacctcaacttcaggattgtttaatgctgcgcggaatacgttacgtccaatacgaccaaaaccgttaataccgacttttactgccatgattatttcctcctttaaataagtgagagatatttatattgagggactgttatcccttaataacttctttgcggctccttcgtccgtgacgagaaccgtgtttcgctgctttttaaaataagcttcgattgcttctgcttttgatgatccgcccgctaccgcgataatgtcgggaatggcatcgaggtcatcgagctgcattccgactgaatgcaccttgtgaacgacttctccgtccgcattaaagtagtagccgaatgcctctgtcaccgcatgattgtcatctattttcttcaaatcttccaaaggcgtgtttcttcgctccgccattgttctagcttcgccgattccgtgaacgagcatactcgctgatttaatcgtctgaagcacctcttttacggaaggctcttcaataatagatgagtaggcgccttgtgacagctggccgggaacgaacaaaagccggtaagtgcctgaagccttttccgccatatgcgcgcatatggtgttcgcctggtttttcacatcttcgcctaaaccgcctcttgcgggcacaaacaggagctcgcggttttttgaatcaggcgtcatcatatcggcgacggcttcaattgtcgtaccgccggttacagcgacgatatttttgcctgaaaatctctttttcatacatgcaacggccgctctccctaattcttttttgacccaaggagattggtcgctgtctccggaaacgataatggcgtctttcagattgagccgctcttttaatgtcttttccaaaagcgtcaatcctaaaacatccttcatcgtatcttccagaatcgaaagcagtgaatagccctcttccgtcattgtcatgccgtttgttttaatatcgatgagattttgttcttttaagaactgaacctcgcttctgagaacgcgctcggtcaatccgagactggctgcaagacttctgcggccgatcggttctgtaagcctgatatactgcaagatttcaaatcttttctgcatcacaagcaaaagatcaggcaataattttttttgagcttgtattaactggttcatgactcaaacgttccttcctattcatactggacagaaaatgtcccgctatgacaaaaaacgtcccatcatagccaaaaaaaattatgtctgctttctttaattattttaacaggatgacattgttaattcaactgttaaaggtcaattcctcgacattcttcgcaggatttaccagtatctcctttatacagtcattatatacagaaatggaatgaaggtgacagacaaaagcccgccggagcggacttttgtcgtaaaacgctttcattttatccagagtttttctatttcttctaatgatttatttttcgtctcagggcagatcgtcacgacaaacaagaaacagagaatattaatgacggcgaatatccagaaggtgtacgcgagccccaacccgctgatcatcatcggcacgaactggccgatcgcccagttggccccccataagaatatcgtcgcaataccggcggcgcgtgcgcggaggtggttcggaaagatttccgaaatcatgatccacgtaatcggcccgactgatacacagaaagcggcgacgaatcccaatatgatgacgactaaagccggaccgctcgccagctgaaaataaaaggatgccccgattaagatcatgaacagcgccataaaggcagatccgacccccatcagctttttccggcctaccttatcgactaaaagaaccgcgataatggtgaaaatcacttcaacgacaccgacgatgcatgtcgtgataaaccccgcattctgtccgaagcccatcattttgaaaatttccggcccgtaatacgtaattgcgttcatgccgatgacctgattgaataaagccagcagaatcccgatcacaagcgcttttctcagccccggtttaaacagctgagacaatgaacccattttttctaattgtaaagacgtttcgatttgtttgatttcttctttcgcggtctgctcgccattaatgcgcgtcagcacggcgagggcttcattccggcgccccgctttcgcaagccagcgcggactttccggcacgataagcagcacgataaaaaagatgacggacggaatcatgccgtaagcgagcatccaccgccagccggtgtgcaccccccattcatacgagccggactgctggacggcaaggttaataaaataagtgccggagatccctaatatcgtaaacagctgatacagtgaggaaagactgccgcgtatagccggcggagcggcttcggtaatatacgtgacagaaagcgaggagcccatgccgattcccagaccgccgatgactctggcgatcactaaggaagacacactttgagaaagcgcagagacaaccgctgacaccgcaaacaacagcgccgctgccatcaaaatctttctccgtccgaaccggtcactcaaaaatccggaaattccgacgccgaaaacaccgccgatcataatgcttgaaatcacgagcccttccataaaaggacttaagcggtacaaatctttcaggaaaccgatggcgccggaaatcaccgccgtgtcataaccgtacaaaagccctcccagtccggccgcgcatgagatgagaatgacaaaccacttcgaatgctgccgagtgacaggtacatttgagccaattggtgccgggtgattcttcatgaattttaccctcccgcgaataatagaataaaaacgcttacaaaacagagtgcggcgcttgagttgctttgttttcttcagaaccgccacatttgtacgtacttataaagaattttatctaaaaataaggaaaattagtacgtacaaataaagaataagcagtttttcacaatctgtcaattatttttacagcttgatgaaagggcttactatgttatactggaatttgtccgtatacattttggaggaattgatatgctaccgaaatatgctcaagtaaaagaagaaatttgttcatggctgaatcaggggaaaatacagccggacgaaaagctgcctacggaaaatgagctgatgcagcagttcggggtcagccgccataccatcagaaaggcgatcggagatttggtctcgcaggggctgctgtacagcgttcagggcggaggcacctttgtcgcttcacgcacggcgaaatcagccatgcattcaaacaaaacgatcggtgtcattacaacgtacatatcagactatattttcccgagcatcatcaggggaattgaatcttatttaagcgaacagggctattccatgctgctgacgagcaccaacaacaatacagaaagtgagcggcggggccttgaaaacctgctgtccaaaaatatagacgggctgattgtcgagcctacgaaaagcgcgctgcagacgcccaacatcggctactatctcaacctggagaaaaacggcattccgtttgccatgattaacgcctcttattcggagctggccgcaccgagcttttccgtcaatgatgtcaaaggcggcatgatggcttgcgaatacgtcatgtccctcggccacacgcacattatgggaatctttaaagcggatgacacgcagggcgtcaaacggatgaacggctatcttcaggcgcaccgggagcgcgggatttttccgtctccggacatgatcgtgacttacacgactgaagaaaaagaaaccgtgcttcttcaaaaaattaagcatacccttgagcaaaacagcggatcatacccgacggccattctttgttataatgatgaaattgcgctgaagacgattaatcttctcagagaattcggcttaaaggtgcctgatgacgtgtcagtcatgggctatgatgattcacatttcgcccagatttccgaggtgaagctcacctctgtcaagcatccgaaatccattatggggaaagcggcggcaaaatacgtcatcgactgcttagagcataaaaaaccgaagaaggatgacgtcgtgtatgaaccggaactcgtcatccggaattccgtcaggcggatcggcgaataaaaaaagcaatgtgcgcggcacattgctttttttgctcagctgttttttaattcggcgatgatctcaaatgatctcattctgtcggcatgctcaaagctttctgaattcaccatgatttcatccgcctgtgttgtccggatgaagctttccagcttttccttcacacgctccggtccgccgacgatcgttgaactgagctgttcattgaccatcgctttttcatacggcgaccagatttgatccatgtcttcaacaggaggcttcagctggttcggcgtgccgcggacgaggtctaaaaatctttgataatgcgatgtcgccagatgctccgccttttcatccgtatcggcggcaatgacggtgacgccgaccatcgcgtacggttgatccagtacgtctgacggacggaaggagcttcggtacagctcaagggcgggcacggtgtttttcggtgagaagtgagccgcaaaggcgaacggaagcccgagctctcccgcaagacgcgcgctgaagccgctcgatcccaaaagccagatcggcacgtccagcccttcgcccggaatggcgcggacttgattgcgcacattgcctgacggtttgaagtaatttctcaattcttcaagctgctccgggaaatcctccccgctgtttatgtttcttcttaaggccctcgccgttaattggtcggttcccggcgcacgcccgagccccaggtcaatccgccccggatataacgtttcaagggttccgaattgctccgcgattataagtgacgaatgattcggcagcataatgccccctgaaccgacacggatttttttcgtgccgccggcgatatggccgatcagcaccgccgttgccgagctggcgacaccttctatattatgatgctccgccagccaatagcggttatagccccactcctcggcgcggcgcgctaaatccatgctgttgcggaacgattcagcaaccgttcccccctgtacgaccggcgataaattcaatacggaaaacgcagtatctttcaatgtatgttcagccatcgttttctcctttatggtttagtgtaagcagatcttaaacaaggtctctaccacacaccttaccacagcttttcccgtgagttaaacaatttgattcgatgatcttcgaacaatcagtcagcggtcgtcactagtgaactctgtatgaatgaatctattacattcagatatgaagagcctagaatgatataaaaatgaaaagatatcattgaaagaacagaaccaataatgttaacatatgtcatatattgaataggaaggaagtcatagtctatatgcgtaaaaaaatcttaatggcactcacaacagctttactggcagcaatcttctttaccggaaacaccgataaggcatatgccgcagacttttattccggcactcagcagcatttaaatgtaagcggatttaccgatgcctcctactacacgaaaaaagcgaaaagtgtcgattttactctcagtacagcgtatccgtcagatcgaacctttaaaggaaacctatacttacagcgaaagtccggaaagaaatggacgacttgcaaaaaaacaaccttttctttctcagtaagggtgactaagtcattctctttaaaaggatgcaagacaggttattatcgtgtcaaagctacgttcagcggttcaaaacttgtcaatacgacaaactcttttaaaattaaccgataagattcagggccctaagatcattagggtctttttattcattctttgtgagctcctgcgcgatttgaataaaaagttttgccgccaatgaagcctcttttacagaaggaacggcaagcagaacatcacggtacaccgcctgattgagttcccttgtcacgacattttccggcagcgatattccggacatagacatttgtgataatatcgctattcccagcccctctttgatcatgctgatggacgtattgacgttgtaaacagtgaatgcggcagtcagcacagaccctgcctccttaaacatatcaataaacggtgattcgtatcctccgtcacagatgatcatcggctggcggtcaagatctttcagagtaattgactcacagctgcaaagcggatgatcatttctaagcacgacggccattttatcttttttcagcggcagatattccatgtcttccgtaggaaaaagagtgatccccacatctattacccgggagcggagccattcctttacttcgttaaccgttccttcatgaagcaccaactcaagtttcggataccgttttttaaacatgctgatcagttttggaatgaaataagcggaagcggccggaaatgtgccgatgtgaatcgttccctgttcaagtcctctttccgcggccgccagctgctcggctttttctatgcctttgagcacctctctgatatgaacgagaatttttccgcccgtgtccgtgagccttacgccgttgcggcgctcgcggatgatcagcttgatgccgagctctgactcaagcgccgagatggcatggcttacggcgggctgtgtcatattcagcgcctgccccgcttttgtaaagcttcccgtttcagcgatttgaacaaaaacccgcagttgtgtaatcgtcataacgttttacttatgctccttataaaaaagattcattttatttatcttactgattaccgtatcatatgatggaattgttctacaaggagtgaacgacgtgaaacagctttcgaaaatacagacggctcttatgctggcgtttctagtcacggtatggggaattaactggccgctgacaaaagctgcgctcgcctattcgccgcctcttctgtttgccggaatccgcacgctgatcggcggacttctattattaatggtggcgctgccccgttttaaaaagctgcgttttaaagaaacgtggccgatctatcttatttctgccattttaaatattactttattttacggcctgcaaacggtcggcttgaattacctgcctgccggcttattttcagccatcgtgtttttccagccggtgttaatgggcgttttttcttggctgtggctcggggaatcgatgtatcctttaaaaatagccggtcttattctgggctttgccggtgtcgccgtcatcagcgcagccggtttcggaggccatatttccatcgccggcattcttttggctctgggctccgcggtcagctgggcgctcggcacggtatatgtgaaaagaacgggcggacgggcggactctatctggatggtcgctcttcagcttctgatcggcggcgtgctgcttgtcagctccggccatttttcagaaagcttttcagcgattcaatggaaagctccgttcattctcagccttctgttcatttcggtatttgtcatcgcactcggctggctcgccttttttacgcttgtcggttcaggggaagcaagcaaggttgcctcttacaccttcctgatcccgctcatatccattgtcgtcagctcgatatttctgcatgagccgctgaccgtcagccttttagccggactgcttctgatcgtcacaagcatttgttttgtgaatataacaccgaagaaactgaaaacacctgctctggccgcagaaaaaaaggccgttcattaaaaaaactcttgccgctgggcaagagtttttttatttattgacgtctcccttttacgagatacgcagccgtaataagcaggtagatggccgcagtgatgcatgtgatgacgatggacgtcgtcgcaattacgccgatcaggatggccaaaagcgcaagcaccgcgaaccatgtcgtgtacgggaaccatttgacgtaataagccggctgttctgttgaatgttttcttgattttaaatgggcgaatccgataatcagccagatgaacagcacggtatagccgagggaacccatcaaataattaaacgtccggcttcctgcgaataaagaaatcaggacgcctacatataaaaatgacgtacaagtcagaatcgcatagacaggaacctttttcttcgatagttttgaaaagattttcggcacccggccgtcagaagcctgcgtaaataagacgcgggatgatccgtacagtcccgagttcatagacgagataatcgcaagaagaatgacggcattcataatatggtcggcacccggaattccgatcatcttaaatactatgacaaacgggctttcgggaacgctgttgacttgattccaaggaatcaggctgacgatgatgaaaaacggcagcaagtaaaaagcgacaatccgcgttaacgtgcttcggacagctttcggaatcaccttttcggggttttttgtctccgccagcgtgacgccgatgatttccgttcctccgtatgagtagatcacgacgagcatcgccgtaatgacgccccccgctccatgcgggaaaaaccctccgtgatccgttaaatgagacagccccggcgccgtgtgattgccgaatgagaaaaataatagcagaattccgcataatataaagatgacaatcaccgtaattttaatgagcgcgagccagtactccgtctcggcaaacagtttcacagaaagcatgtttacgaccgtcaccacgatggaaatgatcaaagccagtatccatatcggacattccggcagccaatattgaatgaaaatggcggctacgaccgcctccgcggcaatattgagcacccacattttccaatagatccagtctaaaaagtatgcagcgtacgaaccgagagactgctgaaccaaatcacggaacgtccttgcatgtttgtttctgacggccatttcggccagcccctgcataataaacagcagaatgattccgccgaggaggtaggccaacagcacggacggccccgcttcatcaatcgccgtgctgctgcctttaaagagcccggccccgattgcgcctccaagcgccatcatcataatgtgtctggacgacatcgtccgttttaacgtttgcttgtccttttccatctatcacacgccctctcgcaaaaagtgttcatcacataaaaaagcacgccgcctctttaggaaaagagacggcgtgcctcaggcagccgcggtaccactcttgttgatcccgaatatccggaatccagcttaaaaaccttttaacgaaggtcagccgttaggacatagggaatattccgacaattccgttccgccctgccacttccgggcgagttcaaagaacaatcagtccgcgtttcaccaacccgcggctctctttttctgactggattcttttactactcccgttcacagtgttttatgttaaatgaatctcttgagtttttattttctgaatatagtaacataatatacagtcttctattttcaaagtcaatactaattttttccgctggttttcttatcacctatataagacattttgactgacatagttatattcatatgtgggttgagtcggccatggagtaatcagcactttatatatttttcccaaacagaaatccctaaaaaaatttctataatgtatggactgagcgacaaaaaggaaattaaaggttttatccttattccggtatctcagcttagtaactgtacacatttcatttctaatagtccaactcgaattaatacgcagggttctatactcggaagtaatattccttttggaaaagctattgacatgaaaccaattccacaaattaaactcgtggaggacactagctggcgtaacacgaaatagtatagatgcattagtggcgttacagctagtgtttttgagtttttaaaggagatttccaggatataaataacaataaagagaaaatcaggtgtagaaagttgaataaaacacctatttttttacaaaaaaatgataataagaggttgatatggtacgggtttcatactttaagatgatgatgtgtcttcactgaatactaaataaacatttccaggaggcgtttcctatgcagtctagcacatcatttaacagcccggcttaccttgaaacaaatggagtaatgaaaatcgctgatataacctatagtaataatgaatggctgaactttgacattggaggagaagggatttttaagaaatcaggttcttatttagttccatctcttccagtagaatttcattgtcatggaatcggtgactatgattttagcaatttagaccaattagatattgaaaagatcaatacactagctgaaatagaagggattttctgtgtaccctctatctttcttcctcataatcaattagatcaatttgcagcctttatgaaagagttccatacacaaaagagaaagggacgttaccgtaatattttaggtatttcactagaaggaccattattggccagctttgcaggcacaccggaaaaagggaattgggcacccttaaaagaagaatgggaaaagatcgcttcatgtggagaatacggtcttatttatactgtactgtctccagatgctatgactgaaaactcctatctaaagaaatatatcaccgaaaaacatccaagtttagaatggattgtagatacacttgtggaggctggagtaaaaccggcgctgggtcacttccaaaaagcatacccggaggaaacctctgaacttataatgaaagttatagatacagcgcaaaaacgcagcaattacactggatcagatgcagttttaacagatcatttgtttaatgatatgccaaacaattttaaacacacctggagaacaccccaagaaagagtacatagattagaggggttaaaagatgctcggctagataaatggaacatagataatatcaacacacttgtcggagaagttcccggtactttgatgagagccgcaaaagaaggtttattaaccatttgtatgaattttgatagtgaacatgtagacttagaagttgcacggcgggttgtagaacttgttggctctaagggtattatagcaatgacagatcgcattgacacagattccatgtgcggccagtcattggaaaaaattgaggggaataatctgtggtatcaaggaaaagggtatgtagcggcaggctcttacacaattgatcggcttatgcataatattcgtgctataggttttaatgagaaagttgtatggaatatgacatcatttgtgccattaaaagcttgtcttttcctaaatgaacttgaaaacctatccatgaagcccttcagttttatagatgaaacgaaaaaaagagctcatttcaaagcgcctgccccagagctaattctacgctaagcaaaaaagaccaccataaagtggtctttttaagttgactttcttttaataagttttaggtccaacttatttatattagggacatctttgttattaattaagttatataataaatttgctgctgtttgtcccaactctttaataggttgatgtatcgttgaaagttctattaccttagatatcggctgattatcaaatcctataaccgccagttcttcaggtattcgtattccctgtcttttcgcttcataaatgatccccgccgcaacgtaatcacttcctacaaccattgccgcaggacgaggtgacttatttagtaataattttgctatttctataccattctcaatagtgtactgttcctcaaagtaccaattatcactccatttcaacccgtattcattttgaaagtgaaaaaatgatttttttctgcttatgccaacaccgctcttaggatttcctatacacagaccaatggattgatgtccttgatttcgcagatgatctattgccattttgattcctgactcatgattaataaatatatgtgcaacctgtttactcgcagaagcttcacaggaaacaatattaccaaacccagatatctcgtcgagtacgtgatgggggcttacacaggatcccaaaataagaccgtcaataagtttgtatttcaatctgttaaaaaactccatttcttgttcaggatcgttatttgattggtgcacaagtaaactgtaattatgtttattacactcttcgcctattccggcaatcagtttactgaaaaacggatggttgattttaggaacaatgactccgaaaacatttgtcttccccctggataggttaatcgcgttgaaattcggtacataatttaattccttcatagcttttaacacagcgtcccgcttctcaggttttacataaggatgattattgagaactctagaaactgttgtccgagaaacgttcgctttctttgctatctctgtaatgtttgtcattactgctactcctttttagacagcgttatcagcatttcacactgaacaacacaagggaaaaaaagcatttaattaattgttttatcatggcctgcatgaatatgtgcgccttcctgtcccacactatagatagaacggggcttccccatcttgtgtaatagtttgtcaaataaacctactaatatccccagacacagcaacacaatgatggttcctatcccaatcggcccctgaagaatgattgcaagcacaaaagctaaagcttcccctatcgtctttgtaatattaataccccaacctgtacgttcagtaatagccagcatcaattcatcattcggtatcgaaggaaaagatgctcttaaataaatagcgattcccatagccaatatacacaaccctatcaaaaataaactccattgaagaattacagcatctgtttttaagaacgaaagaacctttaagtttaaaaggtcaacaaaacttccaataataacaatcggaataaaaccggctagattaggaaaccgcatttttatgaggctgtttataaaaataaggattcctccgacaatgaaaacccatgacccgattgtaaggccaatgagttctgataaagccacgttcagagcgtcccagggggcaattcctgtattagatttaatcatacatacaacccctacggataaaataaacaatccgacaatatagattaaacatcttttcacaaaatggctcatggctgtatactccgcagtttagggtcttcttctttcgtcagaatgtagtgatcaaaagcataagatacaccacactcatcattcgataacgttttaaaagcagccaattgaataagcttcttatctgcatttcccatggctatccctattcctgctgcatgaaacataggcagatcatttagattatcacctattgcgattgcattccgcgcatccgttccataatgttcacaaagtttatttaatgacgctcctttatctactcctgaacttgtgatctcgagattgaatgctcctgaacttgttacggcacactccttcagttgtccaaaatattcttttgctttttttaattttctttggtttggcgaaacgatcatacattttatgacataccgataatcgatagggtcaattgcacccggcatttcctctaacccgtattgatgtatctgagctttaatagaattccaaaatacttcttgattaaaatgaggttcttccattactgtattgtaaagttctttttcaagctgctgaattccttgatttgatacgacaattttgtcagataagtaaagctgataatagatttcttctttatttaaccatgtgatgataggttggattacatctgaatccataaaatgttcgaatattaactgatttcccacatcaatttgagcgccgtttgaagcaatgatcggaaaatccaaatcatatttattgatgatgttttttgcatcaaataaagctctccctgtagcgattgttacaagatgaccttgtttttgtccgagctttaaagctcttacatcttgttcttggatagttaagttctctgataacagcgtgccatctaagtcaattgcaattactttcatgtgaatttcctcctcagagtttaaaaatcattgaaagtataatgtatggtacgcgtttcagagcaattagattattatattaatttgaagtttttctgagaagctgattatactgtgcttctcaagtgttctcctgcttaataatccttctcttttaatcaatccagttaatcaaagaactgactgctaatggggaacactaatttgaagaaattcatctggaacttcaagcgccggcgacttgggcaccggcacttttcagagaacgatcactttttgtgaaaatcggacatatgaagtgtcattgaggcggtgtccccgatatacttttcttctttcatttgcggtaaagaaagcaaaacctgattcccttatgacagaacttgctttatcataaaagtatgcgtttacattcgagtagggaggttatagtatgacccctgtgaattcaagcagcatcgggaaaattcaggcggccagcaaaggtttgtcgccaaaattgagagcgattgcagaccatatcgtgaaggaaccgaaagacgtggttcacctttccatcattcagctggccgaaaaaacgaaaagctctgaagcgacgattttcaggctgtgcaagcggctcggtttttccggctatcaggatttaaaaatcgcgctggctcaggagatcgttcaggagccggtgcagcacattcatgaagaaatgagccccgacgacgatatcgaagtcatcatccggaaagttttccgcacaaacatttccggtctgaccgatacctttcaattattagatccggccgacgttgaaaaagcggcagaaatgatccacagcgcagacagaatcgaattttacggaaacggcggttccgggctgatcgccactgacgcgtatcataaatttatgcgtacgggtataaattgcatcgcgcatacggattctcactttcaggcgatgtcagcgggtcttctcggtcctgaaagcgcagtcatcggcatttctcattcggggagcaacaaggacgtgctcgacgcggtcaaaacggccaaatcgctcggcgccggcacgatcggcattacaagctaccaaaagtcgccgctcacccagatttccgacgttgtgctgtatacatcaacaagggagacggctttcagaacggaggcgatgtccgcaaggcttgcccagctgtcggtcattgatacactgtatttcgccacggcccggctgcggcaggagaaaacgctcgccaacttgcagcaaatcagaaaaatgatcgcgcacaaacgtttgtaatcgttttctaaatatttttttcaaaagagagaaagccgatacagcgggaattgaggcaattttatgaaaaaatttttcttcttcatcgttgatttataaaaaaattattcctataattgactttgtaagggcatacattataaatctatcttattattcaatcagattaggcgggatatattatgaaggaaacccaagctgttatcggtctggatatcggcacgaccagtacgaaagccgttctgttcggaccaagaggcaaagtgttagccaagcattcggttcactatgatttaatacagccaaagccggcatgggccgagcaggatcctgagcacattttggaagcggtgatcggaagcatcaggggcgccgtcacaaaggccggactgagtcctgacaatctgcttgcgatcggcatcagcaccgccatgcactcattgatagctgtcgatcaaaacggcggcctgctgaccaaaagcatcatttgggcggacaaccgcagcgccgagcaatcaaaacggattttaaaagagatgaacggttttgatatttataaaagaacgggtacgccgattcatccgatgtctccgctttccaaaattgtgtggatgaaagaacaggacaaggagacattcgcgaaaaccgccaaattcatcagtattaaagaatatattctgcacgagtttttcggaacttatgtcgtcgattattcgatcgcttcggcaacgggactgttccgattagatacgctttcctgggatgaagaagcgctcaggattgccggaatccgggaagatcagctgtcggacattgtgccgaccactcatcagctgcgcggccttgcgccggaaatcgctgcacggatgggcattcatgcggatacaccgtttattatcggcgcaaatgacggcgtgctcgccaacctgggagtcggcgcgatcggcaaaggcgaagtggccgttacgatcggaacaagcggagccgtgcgttcggtgacggatgcgccgattacggatgaaaaagcgcggacattctgttacgcgctgactgacaagcattgggtcatcggaggcccgacgaataacggaggcattatgctgcgctggcttcgagacgaattcgcttctccggaagttgaaacggcgaagcggctcggcattgatccgtacgatttaatgattgatattgctgataaagtgcccgcaggctctgagggattgctgtttctgccgtttttatcaggggagcgcgcgccgttttggaacccgaatgcccgcggaacgtttttcggcatcagcctccgccataaacgggagcattttatcagagcggtgctggaaggcgtcatcatgagcgtcttttcaatcggtgtcgcattgagagatttggcgggccccgcaaaagacgtgcgggcttcgggaggatttgcgagatcgccgctgtggaggcagattttgtccgatacgatgggacgggaagtcctcgttccggaaagttacgaagcctctgcgctcggagcggccgttctcgctttgcacagccttggcgaaatggaacggatcgaggatgttcaggactggatcagaatttcgcaccgccatgaaccgaacgtcaaaaacagcgaaacatatattgagctgttttacttatacgagcggctgtatgacaagctcaaagatgaatttgacgtcatcagtgaatttcagctcaaacaaagccgttaattcttctttgaaagggtgaaaaggtcatgttactgtttattgtcattgccgctattatcgttttactcttattgattacagtcgctaaattaaatccgtttatcagtcttttgattacatccatccttgtcggtttcgcaacgggcatgaatctgccggacattatcacttcgatgaaaaccgggctcggcaatacgctgtctctgcttgcgatcgtgctggccctcggtacgatgctcggaaaaatgatggctgaatcaggcggtgcggagcggatcgcccacaccctgatcggccgcttcggcaaaaagaaagtgcattgggcgatgatggccgtcgcttttattgtcggcatcccggtctttttccaggtcggcttcgtcctgctcgtgccgcttttgtttacgattgcgattgaaaccggggtttcattagtgacgatcgggattcctctccttgcgggactttccgtcgtgcacggattggttccgccccacccggcggcgatggcggctgtcggcatttatcacgccaatgtcggaaaaacgattttgtattctttaatcgtcggtattccgactgccatcatcgcggggccgctttacggaaaatggattggtaagcgcattcataaacccgttcccgaactgttgaaaaaacaatttattgaacggaatgaaaaacgcaagcttccgggattcgcaaatacattgtttacgatattggtaccggtgatcctgatgcttatggcaacgcttgccgaaattgcgcttccggaaaaaagcacgctctatgaaacttttaaatttatcggagaccctgtcacggcgcttttgatcgccacggtttactcctttttcagccttggtttttatcagggcttcgacagggaaagcattttaaaattcagcaatgactgtctgggaccgatcgcttccattctgcttgtgatcggagccggcggcgcttttaacaacgtcctgattgattcaggcgtcggcacgtatatcgctgacatggcgaagcactcaagcttctctcccgttcttttaagctggacgatcgcggcggtcatccgtgtcgccacaggttcagcgactgtcgccatgatgacggcggccggcattgttgctccgattgcatctgtcatgccgggcgtcagcagcgagcttcttgttttggcaacgggagcgggctctttgattctgtcacatgtcaatgactccggtttctggctcataaaagagtatttcggaatgacggtaaaagaaacgttcctgacatggacggcgatggaaacgattatttctgtcagtgcgatctgttttatcatgatcattaacgcgtttatataaaaacaaaccccggccgcaaaccggggtttgtttttttatcggtcattcacgaggatataagcggctttaacgggtccgtggacgccgacaaccaaatccatttcgatatcggccgagttgctcggtccggtaatatagttgatgcaggaaggaacggtgacgccgtctctgatctgctgtttcagtatatcgctggcctgtgtcattctcggcacaatggaagatttcgggatgattgcgatataggtggtcggaagcaggctgacggaacggccggcatgctctgacgcatacaaaacgacggtggctgattccgcaagcgtgatctcgctgaatgtgatgcccacattcgcttgttccgctttttcaatatttttcgctccttgttccgcgtcccattcccaaacgggaatcccttcgtccggccactcttctgtcataagggtctgcaagccgtacatttcaaaccggctgtccttcggaatgatgacaggccctccttcaaagcggttcacctgcgtgcgcaaagcgtcgtaaagcccggctgcatccgtttcgatcagttcggtatgaatgttgacgcagtggtctttcagcatcgtgacaagatcgtcttccgtacagtccgcatgcgtttgatattgaggctgatacttccattcaggcagggacacgcctgatttcctgcgctctctgcccagacttccggcgatccggtttagaaaggattcctgatgtgtaaccgtccctttcatcatcattcttcccccttttgtttttcccggtctttaaaccaatctctgaatctcgatttatgcggcgccgggaagtcccgtattgccgtccattcttttaacggccccggcccttttgatattttgtcatcctccgtaaacggcgtcatggcggcaggcgcccatttcgatcccagtttataaagggacggggatgacgagccgagcccgaaggctttcatcgccagtttttcgctgatcggcgctttgccctctttttccacaatgttctgccgatgcttgagcagcagctcgtgcagcggaattttaaccggacacgcttccgtacaggccgcgcataaggaagatgcgtacgggagctccttgtattcgtcatatccgccgagaagaggcgataagacggcgccgatcggacccgaatagatggacccgtacgagtgtccgccgacatgccggtacacgggacagacgttgatgcaggcggcgcagcggatacattgcagcaccgattggaattccgtgccgagtatgcgggaacgcccgttatccacaaccacgagatgaaattcctcaggcccgtcagcttctccttgctgccgggggcccgtcagcgccgtaatgtaacttgtaagccgctggccgaccgcgcttctcgtcagcatgctgacaagcacttcaaactcagaaaatgaaggaacgatccgctccattcccatcacggtgatctgcgtcttcggcagcgcggacacaaggcggccgtttccttcgtttgtcacgagactgaccgatccggtatccgcgattgcaaagttgcagcccgtgatgccgacatccgcttcgagaaattttttccggagaacgctgcgcgcgtgcatgacgagctcttccggtttttccgtctgtttgtattcgagtctctctttaaacacgtcacggatctgctctttgtttttgtgaagagcgggagcaacgatatgtgacggcggatcgtgatcgtcaatctggagaatgtattcgccgagatccgtttctgtgacttcacagccctcttcctcaagcacctcgttcatattgatttcttctgtcaccatggatttggattttacgatttttttggcgtttttctgccggatgacatcgcggatataggaggacgcttcttccgccgtttcggcgaaaaagacatgcccgcctctgttggcgacgttttcggcgagctgttccaaatagaaatcaagattgtccagcacatgctgtctgatttcttccgcatgtgaacgccaatcctcccagtttcccaattcctcggccgcctgaagcctccttgtcctgagccgttcctgcgctccggagacggctcctctcataaactcattatctattccttctgatacccgctctttaaaagcggcggtaccgattttcatcgccatgattttacccccttgttgtttctcgtcttatctgctgttcagcacttctgcgatgtgcatgactctgacgtttttatccttacggtcaagacgcccgccgatattcatcagacatccgcaatccgccccgatcagcacctcggcctccgtgtcttccacgcaggcgaccttttcatccaccatttgttcagagatttgcgccattttcacagaaaatgttcctccgaatccgcagcattggtgctttccgggaagcgcggtcagctcgagccccttgacatggcgcaaaagcttcatcggctcctccgacacgccgagcagcctcgtcatgtggcacgatgtatggactgtcgcttttttatgcagcaccgccccgacatcctccaccccgagaacgttgacgataaaatccgttaactcatatgttttgtccgcaagctgctgcgcttttgcggcccacttcggatcgtcctgaaacagatgcggatattcacggaacatcgtcgtacaggaacctgacgggctgacgacgtactccgcttcttcaaacgcggcaatcatccgcttcattgcttttttcgcatccgtcacatacccgctgttgtatgcgggctgcccgcagcaaatctgcccctcgggaaaatccacctcacacccgagccgttccagcacctcaaccgtcgcctttccgacattggtctgaaacatatccacaaggcacgtgacaaataatgagactttcatgatgaacccctctttcatcctcagtatgtgatccggtcatctgatgacctgtttttggaaagctctataaatatcctacactattctgaatatggattggaaggtttttctgaaaaatcctttcgcccgatgcgctgaagggtaaaaaaaagagaagcctgaaagcttcccatgctcctctagatcccgtttttcagcaggtgtcccagtttttgcacaccctcttttatcgcggctttaccgggaaaactgaacgacaggcggagatattcggcaccgtcttcctgatgcggaaaaaaatattttccgggtacataggaaacgccgtgagacagagccctcgccagcagtgcggacgtatcagcccccggcgctttcacccatacaaagtaaccgccttcaggcacgtgccaggatgcggattccggaagatatcgcgctgatgcggcgagcaaaacatcacgtttgcttcgatatgcttcccgcaaggcggcgagccgttcttcaatattcgtttgttccagatagacggcggtcaccgcttgggaaaacggatggcctaagtctttttttaaccatgacaatgccgtgatgaatgcggcgtcccctgcaatccagccgatcctcatacccggggcgatgacttttgataatgaaccggcgtacagcacccggccgttttgatccatggctttcaagggcggcggaatatcggtgaatccgagctcgccgtatgcatcatcctccaagatgagaaaatcatacgtttcggcaagctgaagcaggcgggttctccgcttcgctgacattacggttcccgcaggattctgaaaagcgggtatcgtgtagagaagacggggaagcagaagcccttttcgttttctttcctcaagcataaacgctaatgtttctgtttgcaggccctcttgatctgtcggaatgctcatgatatgcggtgtataatttttaaaaatctcgagcgcttccatatagaccggagcttcaacggcagcggcggtttgttcatcgaggaaaacccgcgcagccagatctatcgcctgacaggcgcctgacgtcacgatcagctcatcgtcccggcagtgaatgccgcggatggctaaccgttcttgaatctgcttttttaaaacggccgtcctcgggcttcccatataatgcagcggcagatcgcgctcctcatccagaaggcgggaggcggcttctttcagctccttatcaggaacgagtgcgggatcgggatagccggaatgcagggggatgcacgctttcggaactgccggcatccattccccgggaggatcatttgtcagagctttctttacatggtcagaaaaaaaagattcggcctgcatgtgatgttatcccctttcacaagtcagcttctatacattttcttcaaaataagcccccagcacttcttccacattcgtcaggtgcgccgtcatcgctgcttccgcttcatccgtgtctccggcggcgacggcgctgtaaatgcgttcatgctcttcatacaatcgctgcacgctcgttcgtttagaaaacagccaaatttttctcgtttctctcattgtttccaaaaggagcgcggagacatgattcatgagatgcttaagcagcccgttttgtgatgcttccgccagcgccatgtgaaaggagaaatctgctttttcgcccaattcttcgtctccgtcgatgtctttcatctccaagagagcttggcggattttttgcaaatcgtcttcggtgcgtttttcagcggccatggcggcgacgccgagttcaagcagctttctgacttcgagcagctgtttgacgtcctcttttttcatcaagagggcggaagaaagcggctgggaaacatgagacggctcaaattctcttatgtatgtgccttctccctgcttcatgtcgacgagccccatcgctttcaaagccgacagcgcttctctgaccgccgagcggctgacctgaaaactctcggaaagcgcctgaacggaatcaagcttttcacccggcttaagctcgcccgcttttatcttctccagcaatgcgtcagcgacttcttcgtagatttttttcgttttaatttgtttatatttcaacgcgatcaccccgtcacttgtgaatcttgatgtttatcgtctattatacttctttttttgtgttgccgacaggttcagacaatttgttcaagaaaagtattgtactttcaaaactttctaaatataatgctaattaacccggtcatcagatgaccttatcataaaaagtaatcgtttacatgacataaggaggggttttttagggatgcaatggacacaggggtacgctcctttagggggaaatttgcttttatcggcagcttgcgcgctcgtaccgattatcttctttttttgggcgcttgcggtgaaacggatgaaggggtacatagcggggcttttaacgttagccgtttcacttttaatcgctgtatttgtttacggcatgccggcggaaaaagcggtgatgtccgcttctcagggagcggtgtacgggctgcttccgatcggctggattatcgtcacatcggtctttctgtataaaatcaccgtgaaaacgggacagtttgagattatccggagttcggtgctctcaattacagatgaccggcgtttgcaggcgctgctcatcgccttttcattcggggcatttttagaaggcgccgccggtttcggcgctcccgtcgcgatctcggccgctttgctcgtcggacttggttttcagccgctgtatgcggcgggaatttgcctgattgccaatacggcgcccgttgccttcggtgcgatcggcattccgattaccgccgttgaaggtccgaccgggataccggcaatggaaatttcccaaatggtcggccggcagcttccttttttatccgtctttattccgctttacttaatcattttgatgagcgggtttaaaaaggcttttgaagtatggccggccattcttgtttccggcgtctcctttgcggccgtgcagtacgcaagctcgaattttttagggcctgagcttccggatgtgctgtcggcgcttgtttccatggccgcgctcgctgtatttttgaaattttggaaaccgaaaacggcctttcgtttcgcggcagaacgggaatcagcagcggccgctgaccgggcgccgatcaagtacgggggcgccgcggtgtttaaagcgtggtctcctttccttcttctgacggccatgatatccgtttgggggattcccggcgtgaaggctgctttaaccggtcattatgaaggaacgtcaatgtggctttcctggctgaatgcagccgggaaagcattgaccttcacgcctcccgtcccatttgtaaatcagcagattcttcaggcggacggcacgccgattgaagccgtgtacaaacttgagcttttcggttcagcgggaacggcgattctgattgccgccgtcatctccaagttcgccctcggcatgtcgtggaagacgtggggcgaagcgtttatagaaacggtgaaagagttaacgcttccggtcgtgaccattgtttctgttgtcggctttgcatatgtgacgaatgcttccggcatgagcacgacactcggtcttgcgcttgccatgacgggcgcgatgtttacctttttttcgccggtgcttggctggctcggcgtatttattaccggctctgatacatcggccaacctattgttcggcggattgcaaaaggtgacggcgctatctgtcgggatggacccggttctctccgttgccgccaattcatcaggcggtgtcaccggaaaaatgatttctccgcaatccattgcggttgcctgtgccgctgtcggtctggcgggcaaggaagccgaccttttccgctttacgattaagcacagtctgtttttgcttctgctcgtctgtctcattacatttttacagcatcatctgttttcatggatgatcccgtaacacggagaacctccccggggtttggctcggggaggtttcagctgtaccgttttctcgccgatgacggcggaatatttaattggtcacggtatttggcgacggtgcgccttgagattcggatgtcatattgttcatgcagcagatcggcaagcttttggtctgaaaaaggtttctttttatcttctttacggaccaatgcttccagatgcgcttttacggcataattggaggcgccgccgtcccccgatgattcagctttcgccgagaaaaatgttttcatttcatacagtccgtacggcgtctgaacgtacttccctttgatggcccggctgatcgttgattcgtggagctccagcgtttccgccacctctcttagggtcagcggctgcattccgctttttcctgtgagaaaaaaggattcctgccgttcagtcaggacgccgataattctcgtgatcgtttgttttctttgcgacaaagcccggttcagccagcgccattcctgatattttgccgacagataatttttcgtgtcacggcacccggcggctgacaggagcggctgataatgggcatgaagctggatgtcaggaaacgaacggctgttgagccgcgcttgaatgatgccatttttcaccgtgatgaaaatatccggttctacgtaaaaacccggctcctcatgcgcataacggagccccggcctcggatcaagcgcgctgatcatgtcagcgatgtcctgaatgtctttaagcggaatgcccgttttctgtgtaagcgctttccaattctttcttgcaaatagctcaaaataggcttcggcaatccattccgcctgttcgttccgctcgggcagacggcggagctgaagaaggatgcattcctgcaaagaccgggcgccgattcccgcgggctcaagggattgaagctttttcagaaccgcttccgtctcctcttgtgaagcggatacatggtcggcggcggctggtatgtcctcttttaaataaccgtttgaatccaatgaatgtatcagataattgaaaatttttttctcatcatcggacagcttcatgtctaaggcttgctgtttgagcgaatcctgcagcgttttgcgggtaagtctgatctgctggcttccgtcccgttctttcatcctgtttttatttgttttatggtaagatagtggcggcgtgtctgtttcctttcgttcaatcagagggttttccagtgagagctcatcaatatatccggccagttccgcggaattgtatccgagtaatgtgatggcctgtttaagctcttgcgttaattgaggctttaacatttgtgtttgctgaagtttgatatccatcatgctcactccccttttttcattgtacatgattggtttcataccgtatatacttattaaaaggagttgctttatagatgtcagaacttttttctgttccctattttattgaaaactttacacagcacattgaaatgaatccgaatgaagaccgaattcatgcgatgaacagctattaccgctccgtcgtctcaacccttgtacaggatcagctgacgaaaaactcggttgtgctcaaaagaattcagcatttggatgaggcgtacaacaaagtaaaacgcggagaaacaaaataaaccttccgctcattcaaagcggaaggttttccttcgtgccggcggtttcaccgatcagccggacgtccggcgcttcgtgcgtccaggtgtaataatagttcgcgtttttcccgtatgaattatcaatgacggtatttggtttcccgagaagcgaggacaggatgtggccgtggagccttgacgtttccaccgattcgtacctgctgaaaaacaggaccgcttttttcgttaagaaatcggaatagcgtttccaaaaccgcgcaatcggcagcgggtttcccgcttttttattcaaaacattcagcgtttggaaaaaagcgattcccctgcggtcgcttgctgacagaacatcctgccagtcacagcttttaacggaagaattgttttgcagcttcgggttgatttccccatccgtgcggataaaataaagcctgccgcgtgacggaaccgctgacgccgcgatcggatacagctgatgggccatatcaggcataagcccgatatgattcgccgaaaaaaagcgtttcgcagtctcgtatgacacatgatctctcgtaaacaggtggagatccttgtgctccgcaaaaagcgccgatgtcttttgcagccgtgtctcatcctgataataaatcgattgcggcaggatgacgatcctgttttccggaaaggatttgacgattttttccctgaacgtctgatagtacggatagagatccccgaaatttccgccaccctgacagacgatgatcgtctttttgtccgcccggcgcccgaatggaaaattgtcgggattccagcgctgtttcacgcggatgccgtgcgctttaaaaaacgcctccgtccctttcataatcaataaatcccctacatttccgtagaggggatagtcggcatatatgatgtcggattgcggcggtataacgctgagcagacccgtcagcgtctcttttaatcggctcataacatggcggctgtccatgttttctcccctttcgtttcaaacagttgcgcaagtgcgtcaatgacacgctgctgctcctcagaagacaggtcagacccggacggcagacaaatcccccggctgaaaaggttctcagagacacgctcatggtcgctgtgaggataaaagacggaagatgagaaaagcggctgcgtgtgcagcggtttccacagcggccgggcctcaatattctgttccgcaagacaggcgacggcttcttccggcgtcacgccgttatcaagcgtcagagccgtcagccagcggtttgaaaccgttccttcaagctccggcatcatgcggatgcccggatatgtttcgagcgcttcccgataccggtgaaagatttctctcctcgcccggacgcgatcttcaagcacttccagctgcgatatccccacgcccgcgagaatgttgctgagcctgtagttgtaaccgagctcgctgtgctggtaatgaacggcggcatctctcgcctgtgacgcaagaaacctcgctttttcaatcgcggcttcatcgtcagacacgagcatgccgcctcccgatgttgtaatgattttgttgccgttaaaggaataaatgccgaaacggccgaacgtgccgctctgcctgcctttatatgttgatcctaaggactcggcagcgtcttcaatcagacagacgccgtatgcgtcacaaaggctcattaattcatccattttcgcgctttggccgtaaagattgacggcgatcaccgctttcgggagtctgccgcgccgctttgcatcccggagcgcccgctcaagcgcagcgggcgacatattccacgtctcccattccgaatcaataaaaacgggctcagcctgctcatacacaatcggattcgccgtggcgacaaacgtaaaggaaggacaaaatacaacgtctccttttttcacacccgcaagccgcagggcaagatggatggcggccgttcccgagcttaaggccgccgcgcttttcactcccgcatattccgcgagccgcgcttcaaacgaattgacgagcggaccgagcggggcaatccaattggttcggaaggcttctgcgatgtattcctgttcttttccgctcatatgaggcggagacaaataaatccgtttgtttgtttgcatgaaatcatcctttttcattatggataggggagatgacgcgggccggaacgccgaccgccgtcacatggccgggaattctgctgatgaccgcagcccccgcgccgataacggaccaagggccgatgtccatctgcggtatgacggacgcgccgattccgatgtgcgttccttccccgactttcactccgccggcaagcgccgcgcgcggtgaaagatggacgtaatctccgattgcattgtcgtgatcggcaaccgcccccgtattgatgatgcaatgggcgccgatgtcagcgcccgcctgaatgacggcgcccgccatcacaaccgttccgtgtccgacggaagccgtttcactgacgatcgccccggggtgaatgagtgaagcataatcggcagcttcaatcccaagcgtttcagcgaactgctttctgacgccgttgcggccgatgcatatcgtgaacacggcctcggggacgagtttccgaagcatgtgcacgtcttccgtccggcccgtatataaaccgttccgagcggtaaaaccgctgaatccgtcgtccaatatgcccgcaagctccatatcggaacgggcctgcacgatttccttcacgacttttccgtgtccgccgtttccgatcagcacgacctttttcacgatgacatatctccgctgcctgtgaagcgctttgccgtcacatggccggcttggtgtatgccttctgacacgagaacttttttcactgttaaaagcagaatctttaagtcgagaagaaaggtgcggttgtcgacgtaccacacgtcgagcttgaatttctcctcccatgaaatcgcgtttctcccattgacctgcgcccagcccgtaatccccggcttcacctcgtgccgccgcgcctgctccgccgtgtaaagcggcagataatccatcagcaaagggcgggggccgaccagactgatatcgcctttgagcacattaaaaagctggggaagctcgtcgatgctcagttttctgatcagccttcccgttttggtcaggcgcagatgatccggaagcagcacaccgttttcatcacgcgcatccgtcatcgttctgagtttatacaacgtaaacggacgcccgttatgccccggtctcgtctgtttgaacaataccggagacccgatggcgcatctgacggctgccatggcgaagagaagaatgacactcgcgccgcacaataacagcgtcgcggccgctatatcaaatacacgtttcaccttcaaatctgaacagctcctttcacttttcggcatttctgtaaagcaagccgcctttcttctttcgtacaaatgaagaaaaaagcgaatgcggcatagcttatgcatacggcaagccccgcggcgatcagaccggcccagccgtcaagcggtgaaaacagccggataccccggcagacggcccaggcaaatacggccgccgccaacgggccgaacatgcctttgtaaaacgcggttttctgaaagccggtaatatgcgaaacatacagcggcgtgaagacggcatttttcaaaatgagggagacagccccggcaatggtgatgccgtacagcccgagatgtgccggtccgctgagaaccacggccaatatgacattcagtccgcctaaacataaagtaacgacggcgggcgttttttgtttattaaaagccgtccatacgtaaaaaagcggcatgacagagagactgaccgccaaatacgcggcgtgaatatataaaagcggcgccgtctgcacaaacgacgggcccagccaaatcgccagaaacggttcggcaagccctcctaataatgcggcgggaagcgcgaggagaagcccgttcatccgcacggccttattggcgtaagacaggagaccttccatatcgccttttgaataataggaagtcaaaaccggcgcaaacagtgaagcaagcgtcccggcaagacttctgagcagaagcgggaattgaataatcgccgcatagacacccgcttcagacggccccagcacgaggttggccgtcatgaggtcaatctgcagaaacagcagcacgccgatctggttgacagaactccaggcaccggccgaaaacagcactttgcttgtctgtaatgataaagttttacggctgaaagaaaaccacggaatcaatttcttaaagaagaaaaaagtcagcacagctgcacagacagctcccgctaatgccgaaagctggatctgccagatcttcggcggcaggcacgtaaacagagcgagcacacacagcaccctgaccagcatttgcacggcctgaatggaacttgtgatataaagcttgttggcaaaaaacggccccgtcgcgaaccccgccataaaaaacgtcagcataaacagcacgctgccgattacgatagacagcctcacatccgttaagagcccggccggtacattcataatcctgtcaataaaaaaagcagtcccggcgagcggcacagcgagtaatagagatatcacgacagacgcggctaaataattgcttacatacgcattggcctcgtccctgttccccctgtgggcggcgacggagaaaaacctcacaacgactgagctcagcgcaacggtaataatagagaaatagttaatgatattctgtgtcagatggacaaacccaaaagcctcaacacctaatgttttcacaataaagggcgtcatccacactgataaaaacaccgatagtaaaaacgccgtcacattggcgccgaaattaatggcaaatttcatgctccttccgcactgcctttctctttcgatttccgttcgaaaaacgcatgcagaagaagaggaaggcgcattttgcacagaccgagcaccacgcgctccccggccagcagctgtttatggcggcacggcgtcctgcgcacggccgtttttaccatgtcatacgttaagattctgccgatatgcgccgtaatctggtgtgacggctgcggggcggcgcatgcgttggcgatcagcatcggaatctgatgcttgcacaaatatgtatcaatatcgctccgacaggcgtccgtcagcccgtttgcctcataaaaagccattttcgctgcatattgcttttgcagttcgtgatctaagcggggcttaaacggtgtttctgtaagactttgcggattttcccggtagatatacagcccttcgtctatcactttgacacgcgcggcttggcggaacgctgccaagttaaacggagagtcctcggcaaaccggatatcttcatggaacaacagcccttgcaatgcttctcgccggtatatatagcgccacacataccaaataaaccgatgttcgtgcgcgcgggtcagcaatgcggtcatttcatccgctgtgaagacgcggcccggcggaagggacggcggcatatacgttcttttcttagacggcgtttccttataataaccgcagccggcgatatccagccggttcttctccgcttcttcataaagccgctcgaacatcgtttccgtcacatagtcatcgccgtccgcaaaaccgatataacggccgcgggcggcttttattccggcattgcgggccgagctgaggccgccgttttctttatgaatcacccggattctcgcatcttctgcggcgaattgttcagccatccggcctgactgatccggtgaaccgtcattgacgaaaatgatttcgatgtctctcagcgtctgttttgttaaagaaaccgcgcattctttaataaaaggctctgtcttatacatcggcacgatcacgctcacaagcggcgcggtcattgggcatcaccgctgattttcgagcgcagcccggcaaaataaacacttcgcaaagaaccgccttcctcatgcttgccgctgagcagccgatttacggcggatgttacggcttcagggtccggacgttcaagcaatgtcatgttcggtatgtttttcagccattgatagccttccatcaccttatgatcaaacgaacgaatgacgacacaaggcgttttcgtcagcgcacaaaaaatcatcccgtgaagcctgtcagtgacgacggcttccgcgcctttcagcgtattccaaagcgcttccagctccttttcgcgtgtatggcggctgaccctccggccgaccgtcgtggtaaaggaatacagctctccgtactctttggccaaagcttcttttaccatcgttctgtcctcagccgtcagcgcgctctccttatcctcccgtaaacagaggtagatcccttcccgcgctatgccccgctcgcttttatccaaatataagaccatgtcaggctgtttgagcactgtttttccgggaaaatgacgcttcatccattgatacgtcgtctcatctctcgccatcaacaaaaggtcgggatgcgcattgtacacttttcgggcgcgcttcagttccttccgtcccttttttgattcagaaaagtgagccgtcgccggaagctgaacgatccgatattgccggaatgtttttatgataaagcggcgcgtccattcctcataccggtacaaatcccccatattcccgccgccgatgatgaataccatatcatcagggtggcgttttttgatcagcacttttgccgatctgtatatatccttcatatccacctcgacaatgtcaaaatcgggatactcccgttcaagaaacgttttgcttgcgtaggcgatggcgtgatcgccgagattatcatgggacgggagcagcgtcagaatgatcttttttcttgccgctgtaagccccgccccatccgctgccgttccgaaatgaaattgggacgggtatttgaccttaagcaaaagccattccgcgagattgatttttaaagattgtatcgacatgtcttcaccctctgattttcattttgtactcgattgcccgctgatacgcggctgatgccagcgacacgaacggaatcagcttcagcttcgccaaaagcagaaggcatgagcgtttggcgtcaaacggcgccgttcccgttttggaaaggctcaggcggaatacgggatcagcgcatatccggctgatattcttccacttctcagaaaaccggccgccgttattccgcttccattcattcagcaggcagactgttccgtgctgaacgataaaaaaatccagctcctgccggtattcgtgtaagcagccgttttcacgcaaaaaagcttcgttcagccgatagagaacgagacctgagtcaaacagctttttctgatagctttgcacaatggaagtcaagtgaatccgataatgatagagcggctgatccacgtacgagaccgcacctgcgaaaacatgcgcccggaggctgaaatactgatcctccacgtgctccagctcatcacgaagcggaaagcgcagctgatgatgctcgatcatagatcttttgtacagcttgttccatgaaaagccgctgactcttccttcaaataaatctttcaggtaccgttgtttcgggcggccctcgtacgctgaagcgatcgttgaaacggcggtcttccccgtatccgcaaattcagccgcatattcgcaaatcacgagatcagcctgatcagccttcgctttttcatacatgcgcaggcaataatcaggttcaacccagtcgtccgcatcaataaaagcgataaattcgccgcgcgccgcctcgatgcccttgttgcggaccgcgccgagcccccggttttgctgatgaacgaccctgattctctcatcccgcttctgataggtttcaagaatcgccgggctttgatccgtggacccgtcattaacggccacgatttcgatattggcgagcgactgattgagcaatgaatctaagcatctttctaaataagtttccgtattatacacagcaattaataaactgaccgcgggtgtttccatataaacctccagtgtccattaccgggaaaaaatcgttctgtacggaagcacagacgaatcgaccggcataagcaagtaactgtaaagaaaataacagacaataatggcgatataaatcagcgcatttgatttttcatcaaaaattctcacaaaataagggatcaggatcatttggtacaggccgaaatatatattaaaccgggcgaaaataacatcctttgtcgccaaaagaccgaaaagcaggccgagcagacagaaattcacgatgacatcaatgtcaggccagagcttccgcagccgctcccggtagcagaaagccaaaaacagcggcagcagcagcaccgcgatttttacgacgttcatcccgttcgtattcgtcatcagccatttctcataatggccgtacgagctgttttccagcacgacgacaaacagcgaaatgaacttctgatacagaaacgtcataagaagaaacaatgccgacagtccgaaaatcgcgggcgaccaggctctttttctgacgagaaaataaaccggaatcataatcagcgctgaggaatgaaaaagcgaacacagcagcacgattgacatataacgcttccagcttccgctgatcacgtagcggacggcccaaaacaaaacggccgccaccatatactgcctgatcccgttaaaggaagcgtaatagtgatacgtgcccaaaaacaaaaatacactcagctcaaacggacggccgaactcaacgagcccctttaaaataaagctgcatgtcacgaccgccacggtgaaatacatgatttgcggatctttcgtgataaaattcatgagccagatgagagccgtaaaccccggatcaacggctgcttttttcgctccgaacccgaagatctcccaaatgctgccgtaatttcccgccagcttgtacattagcgcgtacgtctgaaaatccgtcccgactctgtagcgcaaaccggagaccaataccagcgatagcagcggaacgagcatgacgagctgattcggccggtatccggtcgaaagcgattgatcacgcccgccgcacattttcgcgaaccatgaccaaatataaacaattcccatattgactacatatacaatcattcgttactgttcctttttccaattcatattgtaaagcttcataacagcccccgtattttctcccgcgtcatatcccagccgcctgagggtttctttaatgcgcgccccgtcaggctttgccgcctctgctgcccgtaaaaccgcggatgcccattgtcccggcggttctttgaggctgagccttttgaccagcccgagcccggcatcggcttcttccgttatgccgtctgatatcacgcacggcaccccggaggcctgcgcttcaacgagcgtgacgggcagcccttcataaagagacggcatgacaaatacatccagcgttttcagcagatcatgaacgcggtcttctataccgataaaacgcacatcatcatcaagccccagcttcgccgccagattttccatatcggtgcgaagcggaccgtctccggcgagaatcagctgtaagccgatgccccgctctttcatatcagcggccagccggagcagaaattcgtggtttttttcttctgtaaagcggccgatatggccgatcaccaaacggccgtctgcaatgccccgcttccttttttcagcttctgtgtccgcgcacccgccggcaaataagtcgagatcaatgccgttcggcaaaagatgcacgtctttttctttcccgaataagaaacggcccgcctcttttccgcaggcgcacagtgccgtggcgtttgccgtgatcagccgtctgaaaacaaacagctgcatcccggcaagccgcgatgcccgcccccgccacgacgtactgtgcgaatggcagatccgcaccgggacgccggctaaacgagcggcaagcgcgataaatccagactgaaaatcggtatgggcgtgcacggcggcaaacgggcctttttcctgaatcatccgcttgacctgttttacaaatgtaatcgggtttgtgctgccgatgctcggcacataaaaaagccgtccgccgagagcgagaatttcctcgtcataagcgcacggatcgttcctatgggttaaaaaatcaaactgcaccttcgttctgtccatcttccggtacaaattcatcatcatcgtttctgcgccgcccctgttcatcccgctgaagatgtgcagcacccgcatcggtttgtcagtcatgttcggcaagcccttctttttggcggatgtccttgtttttatgataacggttcatgaccgcgggcggcgtaatggcgcggatgagcggttttgcgatatacgcgtaatgggaaatcggcagcttcagccgtctgcatgcctgaaaaacgagcaccgcattatcaatggaatacgtaaacgatctccttttgaacgcatcactgtcctctcttactttatacagcgtttcctggagattgtaccctcggaaacccgcttcaaaaaagcgcagccacaaatcgatatcctccatccgccgcgtccgcctgactgaccggtagcctccaagcgctttgtacgcttcagcccgcatcataatggtgccgtggcagaacggtgtgcctttcgccataattcccggtttcggcacgggcggcaaaagccgggcgcccctgacgccgaattcatcaaatacgagcatccccgtgcccacgacttgatagtgggcgtgcttgtttaagaaagcggcctgtttttccagtctcctcgggttggagatgtcatcaccgtcctgcctggcgatataatcccccgttgcgtatgtcagacagcggttcagcgaagcggcaagccgttgattcgtcttattttgaatcagcgtgatccggtcgctgtaatgatccgcgtaacggcgcgcaatctgatacgttccgtcagttgacgcgtcatcacacataatcagttcccaattcttatacgattggctcaggatggattcaatactctccgctaaagtctcttcgcaattataaattcccatgatgacggaaattttcggttgtgctcctgcattcatacgcttttctcctttttatccatataaccggcgtaaatgtgcgccatttcctttaccgtacgtgtttctgaaaaacattccgccgtcctgcgcccttcttgtcccattgcttttcgcagacccggggatcggtacagcttttcaatccgatcggcaaatgccgcgctgtcccctgccggcacgagaaaaccgttcacaccgtcttcgatgatctcacggtgccccctgttgtctgcggcaacggcgggcttttcggcagccatcccctcaagcagattcataccgagcccttcgcggatgcttgaggcgacggacagatcagcaagctgaatcagctcatgaatgtcacggcaaaaaccgtaaaaccgcacaatgtcggataccccgagtgattcagccttttttctgtacggctcttccatcacgccttctccggcaaatacgagtttcagctctggaatgcggttcttcagcagtgccgcagcctcaatgagaagtccctggtttttattgccgtttaattcagcggggtatatgaggataaattccccggcgccgaagccgtgtttttctctcagacgttcactctctgcccggctcacagggcgaaacctgtctgtattcacgccgatgccgtgtattttcttcgcgccgcaagctgtttttttcatttgcttggcccgttcgtaatcctcttcattaatcgtaatcaaacaatccgtgtaagaagagagaaatttttcgatcgggtaataaagaagccaatttttcaggggcgctccgtcgcagaagtgaaagccgtgcgcggtgtacagcacctttgtccctttttggcgcgcttgtctcgccgcaaggcgtgcaagcacgccgccgaccggcgtatgacagtgaatcatgtcgtagccgttagcctgaatgagccgtttcagccgcctgtaaacagaaagattttcgggatgaaacggcgagcgccggatcggaatggaaaacttttcatcaacgaacggaagattcatattgccgcctgccgcgacgtgcacctcccagcccatatcctgaaaccattgaaaatacggaagatgaaaggctttaaaatgataatcgacagtggcgcagaataatacttttttcgtcatctttctgtcctcccatcacacacctgcggccgcttcttcatgtactgattcgatcgcctcaaacagccgttttctcagctcatcttcaggcagacggctgaattcctccataaaacggatgagcacggcccaatccccgtcgatcgctttcccgatatggattttcggaaaaatctgttccgtatgtacttcattatgattcagcagttcttcatacatcttttctcccgggcgaatgccggagaattcaatgggaatctgttctgtcgtatagcctgataaatgaatcaggttttttgccaagtcgacgattttgacgggttctcccatatccagaacgaaaatctgccgcccttttgcaagcgcccccgcctgaatgacgagtcttgacgcttcggggatcgtcataaaatatcttgtcatcgccggatgcgtgacggtgacgggtccgcctttttcaatctgctttttgaaaatcggaatgacgctgccgcggcttccgagcacattcccgaaacggacggcggcgaatttggtgttgctgacctttccgaggttcatgatgaccatttccgcaaaccgcttcgtcgcgcccatgacattggccggattgaccgctttgtcagaagaaatcagcacgaatgtttccgttccgcacatatcggcggcttcggcgacatttttcgtgccgataatattgtttttgacggcttcttccggattatgttccattaacggcacatgtttatgggcggccgcatgatagacgacgtgcggctcgtattttttcatcaacgtaaagattttatctctgtcctgaatatcggcgatctccgcgtgaaaaagcacctctttgccgaagcgtgcggacagttcgttatgcaccgaataaatgctgttctccccgtggccgagaaggacgatttcatgcggaagaaacgagctgatctggcggcagatttcagaaccgatagagccgccggcgcccgtgaccagaatcgttttccctttgatgctgtcagaaattttgctcgtatcaagggtgaccggctttctgccgaggagatcttcggctttcacatccctgatgtgtccggcagcctgcgttccgagcaggatctcatcaaattgcggcatgattttaatatgggcgcccgtctgtacacattctttgtacagcgtctggagctcatgggtgcaaagagacggaatggcaatgatgatgtggtgaattctcagcctctgcaccgccggcataatgctttcttttccgccgatgacgggcaggcccatgattttgagcttatgcttcgtctgatcatcatcaataaaagccacaggcatgattccgagatcatttttctgggtaagctgacggacgagcagcgttcctcccgcgcctgcgccgatgatcagcgcccgggaagagtcattttgcttccttccgatcgtttctttcagcacgcgcgaaatcatccggctccctccgatgaacaatagctgaaccatccagctgacggctaacagccggaacaaaatcgtgtggaacaccccgtattggacggcggctgtgacagctgcggacagcgtgatccccttcagcagatcaagcagctcgccaattcccgtatacgtccatacctgcttatactggtgaaacataaaagcgcatacatgatggctgatcagcatggtcacggcggtcagcagcaacgctccggagtcataaaagtgataagaatcctcaaaaaattgatatcctataacaacggaaagtaaaacgagatacgtatccaatgcaaaaatcattgaaagtcttctccggtaagtcaatctttcccctcctcatttatcggtttagctgatacggttttcgtaaaaacagacataacagctaagccgataacaatgcatcatcttaagataaattgggcatttaacccgtcctcacaccccgccaccgacgaccagcatctaaggcggcggaaaacgccgcccacagcagagccgagtgcctccgttgataaaggtaaggagacatcacctgcaccgctcaatacgagtagtgctctgtttttttgattttctttttattcagcagcgcccccaaaagctttgcctttgactgctggagcgcgtctttcgccttttggacggtatccattttcgtttttccgctcaagacgacgagaacgcttccatctgtctggttcgctaaaatctggccgtccgccaccgccaaaagcggaggtgaatcgaaaataaccagactgtaccggctgtacatctcctgaatcagctctcccatcgcctttgaagataaaagctcggccggattcggcggcgtcggcccgctcgttaagacgtaaaggttatcaatcagcgttttttgcaccgtttcgccgagggaagcgtttccgactaacacattcgtaaggccttgtacattttcaagctgataggtctcgtgtatcgtcggttttcgtaaatcggcatcgacaagcagcacctttttttcctgctgcgcaaataccgcggcaaggttggcggcgctgaatgactttccttctcccggaacggaggaagtgacgagaatagagcgcaaatgggtctgaacagaggagaactcaatatttgtccgaatggtgcggtattgttcagccaccaatgatttgtgatgtaaaacggatatttgagccagtccccttcttgatttcttttttctgaatcccaaacgcctcactccccgaaatgtttttcatcagaccgtgtctgctgatttttgatgtcatacacaacccctaaaacaggcaagtctgttttttcgctgagctgccgctcgcttttaacggtttcatcaagaaagtggagaaaaaacgcaagcgtcacacccgccatgagagccgcaccgaacgccatcatgatattcctgatgcgcgaaggcttgaccatcgggctttccgatgcttttgcctcggacaaaacaatgacgccttttatattcatcctgtcacggacttcttttttaaatgtcttcatcagcgtgttcgctatagcggcggcctgtttcgggttctcgtcctgcaccgctgcgttaatgatctctgaatcggtttcgctgcttgtcgtgatctttgcttttaaagcggatgccgtctcagaaagatgcagcttctgtttcactttctcaagcacaaccgggcttttcattatcgtttgaaacgtattgttgtaatgaagattcagctgaacgtcgctgagattcgaatttttttcaccgcttgtttcatgaatgagcacttgggtcgatgcctgataaacgggcgaaatcacccggaattggatgtatcccgtcaccagcgttacaactgctgtcatgataaaaatcagtaaaaatctgtgtttaataatgtcaaataactctttaaaactcatattctcattcatgtaattacagcctcatccttattgcatcaggcttaaacgcccccttctgttaatgattggattataaaagaaaaggtcgaaatttgaaaatttcaaattaagccatttagttctttttagagaacattatcatgattttcctcttatttactgcacttcccttataattttaaattttataaagaacgaaaaatttcttataatgaacaaaaaaatgccagtatacaggggagaattcagcacaatgattggaagaataattcgtttataccgcagaagaaaaggctactctattaatcagctagcagttgaagcaggtgtctctaaatcttatttaagcaagatagaacggggggttcactcaaatccgtccatccaatttctgaaaaaagtatccgccaccctgcaggtcgatctgacggagctttttgatgccgaaacgatgctgcatcacatgggaggcacggaagatgagtggcgcatccaccttgtgcaggccgtgcagtcgggcatgccgaaagaagaactgttcacctttacgaacaaactgactgaaaagcgcccggagcccgcaccctaccgcaacagaaaactgactgaatccaacattgaagaatggaaagcgctgatgcaggaagcaaaagaactcggcttgtccgttcaggaagtcagatcatttttagaacggaagcgttactgatgatatgctgatgaaagggcttttattcgcttcatgccttcatctctgtttataatgaaaagaaaaaaggggatgaaatcatgacaaaacttaccgttcaaacccgctgcggcgcactgaaaggaactgccggccgcggtgcccgcacatggaagggcataccgtacgcgaagccgcccgtcggagagctgagatttaaagcgccggagccgcccgcaccttgggacggcataaaacatgccgattcgttcgggccgatttgtccgcagccggatgatatgctgtccatatcgttttccggagatataccgcctcaatctgaagattgcctttacctcaacgttttcgcccccgattcagaggacgaaaaaaagcctgtcatggtatggatacacggcggggcattttatttaggtgccggaagcgaaccgctttacgacggatctgcccttgccgctgacggagatgtcattgtcgtgacactcaattacaggctcggaccgttaggctttttacatttgtcttctattcatgacgcgtattccgccaatatcgggctgctcgatcagatcgccgcgctgcgctgggtgagggacaatatctccgaatttggaggagacccggataacgttacgatatttggtgaatcggcaggcggcatgagcatcgctgcgcttatggcaatgcctgacgcaaaaggcctgtttcataaagccattttagaaagcggcgcctctcatacgatgccggcggatatggcaaaagacatcgcggcggcatttattcatgaagccggcactgatcaattgcaggagctttccgttaatgacctgcttaagactgcggataaagtgcggcgctcactggatcaaaacatttttcagcttttgtttcagcccgccatcgatccggccacattgcctgcggaaccggtgaaagccatagcagacggggccgcagaaggcatacctatgatcatcggaaccaatcgtgatgaagcatatttgtttttcacccctgatacagacattcactccgagaaaaagcagcaagattatttgcattatcacctcggagaaaactgcaccgagcaagcggcagatttatatccgcattcattaaagggacaaatcgatatgatgacggatctgattttctggcggccggctgtcgctttcgcacaaggacagtcgcaacacgcaccggtctggatgtaccgctttgattggcatggcgaaacaccgccgtttcataaagccgttcacgctctggaattgccgtttgtgttcggaaactttgattctttgagaaagacgctgcaagagccgctcggtgatgacgcagaacagctttccaaacaaattcaatccgcatggctcgcttttgcaaaaaacggaaacccgaacacctctcactacaattggcctgaatatgaaaccgattcacgcgaaactttgctttttaacacggataccgctgtcgaaagtgatcccgattcagcaaaacgccgcatcctgtttcaagcataaaaaacgccaagggagccggctcccttggcgtttcgctttcatctcacttcataatgcaactccgcaaattgtttgtaacgcctgacatcagtcagcttcagtcctgtctcccggtctccgggtttaaacaaagaaattccgcggccgagcagaacgggggcgatctgaatgataaactcatcgacaagtttttcctccaaaaccgggtgcagcagatcactcccgccgacaatccaaatccgcttgccttcttgccgtttcaatgcatttataaaatcggcaggctcttcatgaataaaccgcacatgttcagtacgcccggtcaatgtccgcgaaaacacatagcattctttacctttgtacggaaattcctcaggcaataaaaccaatatttcctcgtatgtttttctgcccataatgatcgtatcgacagattcatagaaagcttcataatcggtgctgtcttcaccttcagttccgattaaccaatctaaagaatgattttcccgcgcaagatagccatctgcgctgacagctccgtaaaaaacgagctttctttgaccgctcataaaaatccctcccccttttttattataccttaaacatgcgggtgaaatgaaaaatgataaaatcgggtaaaaaccgccgttaccgggttttcgtttcttcctgctttggagatgctgttaatatgccgtctatccatcttccggtaatcggcataaagaaatgaaggatgatcccgcctaaacaaacggttaataacgttccgatgcctaccggaccttttagcatcacggccagtatgaaaaatatgaagtaaatgaccgttcttgaaaaaaagatgcttctcccggttaaatcacggacaattagcgttaaccgatcaaccgggatcggtgcgaaatttgtgtgcagataggttgcggttcctatccctatcacaactaaaccgattgcaaaacagcccgcctttccgtaccatagttcaggcgttatgactcgatgcagaaaaaaaagccacatatcaatcccgattcccgttatgaacgccgtaatcatccctgaaaattccggtctttgcctttttaacattgaattacagcaaattaacaggaaagcgatgatgatttcccagcttcccacggtaagccctgcatggacggacaatcccacaataagcgcatcaaaaggcgatgttccaagatctgattgaatcgtgacagaaataccaaaggtcaagatcatgattcctaaaacataaaaaacatatttcactttatcgtcctcattttcttattttatgttgcaaatacaacaaaattacggtatgtttactatacggtattttcattgcaaatacaacaaaattcagctgatatgataaatgaagaaaggagctgtatgaccatgagtattcaattaaaaaagtgcagccttaacgatataacagagctccgggagataagcattgaaacattcaatgatacatttaaagatcaaaattcacctgaaaatatgaaagcttatttggaaaatgcattccgctctgaacagctgaaaaaggaattatccaatccgtcttctcaattctattttgtttattatcatcatgaccttgcggggtatgtaaaagtcaacatgaacgaagcacagtcagaaaaaatgggggaagattctcttgagattgagagaatttatataagaaaaagccatcagaaacacgggcttggcaaatatctgctgaatgaagctgtgaaaatcgcaacagcacacaataaaaagaacatctggctgggcgtatgggaaaaaaacgaaaatgcaatcgccttttatcaaaaaatggggtttgtccaaaccggagaacactctttttatatgggggatgataaacaagtcgactttatcatgaccaaaaccctctcgtaaaaggatacaaaaaacccggccaagctgccgggttttttctcttattttaattttcccgcacggatatcatcggtcattccttcgtacggcgcttctgaaatcaatgtttcgttattgattcccgcattgttaagatacgtaatatccgcaaactcgggaacgacatatttcgggtatgtttcatatttctcacgtgactctttcatcacgtcaatgtaatcattttggtagcacaccgtgatttccggatgctcatgcacccatttcgggaagaaaataattccgtgcatccgtttttcattcggcataaagtttaaggaaacgtctgtgcctgtcggttcagtccatgacactttgtatacgccttctgtcagcttgacgatattcacttcctggtcgcgcacccagcggccgcctaccattccgctatgaatccgatagtcgatcgtatgatcatttttaatatagatttcatactcccagccgttttcatacgtgtaaatcatatggcttccgataaagttttccatgttgactcactctccatcttattattgaatttcataaatatctaaccgaatgtcatccggcaatctgaccgcagccccgataaacagccggtcctgcagatgctgatatgcctcactgcttgtttcaaacacaggcacagtgcggaaatacacgtgctcgggatcaatgatgcgtttcactgactcataaatgacttttttaaagaaggttcattcaaggacgtatcacctcccgagacaatatgtttgtttaaacatgtaactatttacatgattaattgtaacgctgttaaaatggactgtcaaataatgagctgtttccggttatgttttacagtgttcaataaaaaagacaagggcggcacatgccgaaacccttgtctttttcattaagcttatctataaaaacgcagacgagcgtcttcttagtaatcacaatctttatctctgcattctttctcacagcatctatagtgtgtcccataatcttgtcatttgctttatcataaataccgtcaaatttatttgatgtatcatcgttgtaatagccaaatacctctatcccgcccattggatctgtttcatatttatctttaaatgtaacgttatgtatgccttcataattcgctttgataaatttctccattcgttcttgagcaatctttatctcttcagcctgaacatttttatcattcatactcttcattataaaacctccagctgctattaagataatgaagataataatatattttttcacagaatcatccgtcccatcagttataatgaagctcgcggaatggaaaaatggtggtgacatccgatgcatttattcaatgtccgcagaggatcatataagcggcaatccagagtacttctttattccagcgtctttttagtattcacattctttttcctgacattcgggtttctcttctgcatcgactgacgaaactcctatttcatcattcgttttgtcataaagtccgaaaaattctttttccttattaccattcaagtaccccttcaaggaaataccacccataggatttattttataattgttaatgtatgtaatccgctttatatttttgtaattagcttttatataactttccattttatttttcgcttggataaaaagttcttgttctgcttctttttaatcatggtggtacttcatgtagatacttcctgacgctatagttatcacaaatattagggcaattttgcatctcttcacaaactcatcctttcttagattaaatttatatcaacctcggggtgttgtacatgtctaaaaaacatcaacgtatcaagtatcagtgatcgagaatacttttttataagcgttagttatagttagatctaggttaaatgaagtgatgaaggagaaaggaattcaaattcagaaggaattggctgatttagttggttctactgaggctgcgataagcagatttaaaacaaatacaagatatgatatcacaacactattcattattaactgaggattaaatgtacctatggaagatttgttttatgtcgaggagatagagtaagagcaataaaacaaaattagctcagctcgattgagctggctaatttatcttgtacaaagcttatctttacattcttctttgggttcggcatcaaccgtatatgataatatttctttattgcctggatcatatagaccttcaaactctttttttccattcgtataacccttaatactaataccacccattggattaatatggtaatcctcggaaaaatggatattatccacatttttataattcattgttaaaaacttttccatatgattctgggcttcttcgaataacgcaatctctttttccttctgatcatactgatgcttcataaaaagtcccccaactgctataattattaaaataaggataattatgtactttttctttttcatttggaaatcaatcccttcctataaataactgtcgttcttaagtaaacgaaatgagcgaaaacttgatatgaatatactttcagcatgtcaaaagcaaagctaaccaattcagaattcatcgcgattgttgctgacaagttaagattggaacttaaagcgagtaaaatgctgatctgacgttttcctgtcgttgagttgtcatgatatttgtacgcgtttaccgttaatatcggggatacctcgacaaatgagacggtagaggcgattgatctcaggaataggtttgaactgtatgagaaacatatcacgaattttgtaagataattaaacaaaataaatacccactcatcctgaggtgggtattttacctttcttcggcattgaccactgaaatacctatctccttgttcgttggatcatatataccggaaaattctttttctttattattatttatgtagcctgaaacttcaactccgcctgtcggatcgatattgtagtcttttgaaaagtgaacttcctgtacatttttatagtctttttttaagtaattcctcatatgatcttgcgcctcaatcacaagtttttcttcgtttttatgtttatcatattgatgcttcacgaaaaaacctcccactgctataattataacaattaggataataatgtattttctcatgcgtatcatcctttcggaactattttacaatataagaaaggtgatgtatatatgccaaaaggaaaagaaataaccgtctctgatgtcacagataaagaatattaccgtttgagtcaagcagcttacaattataaaatgttagccctgcatatgaaatataaaactccttataaaataagtaagacgtcatattggtacgttgagaaagtgaagcaggattctgatacgggtcttgatgcctttgtattctcaaaaggcatcaagtccaaaaacggaaaatggataaaatcaaaaaaccccgaaaacgtggtcgtcgcttttgcgggaaccgatatcggaaaagacccgatcaatgacggcgtaaaagcggacggcggcaatattgttttcggtaatgatccgcaaaaagaagtgtattatattgtaaaaaaagacgcggaggatacctcgaaaacactcggaaaatataatggaacgccctctcaagacgccatgctcacaaccggaaagtataagctgataacgaaaacatcgcaaatcgatcaagccgatcagctggtacgcagcgtaaagaaaaagtatgccggaacatcaacgattatttcaacaaccggccattcactcggcggcgctgaggccgaatacagcgcggtgaataatgatgtgtacgccgtcgcgtttaacagcccttccgtcgtgaaactgcacgatgaggaaacacagaaagacatcaacagcggcatatacgatccttacatccggtcaattatcaatccggacgacatggtcggggcgggttattggaacgaatatgaccgccacaacgggacaacgatttatacgaaaaacccctcactctcacagttcagccggaagcagcggcttgatgggaacttgaacgagcagatcggcaaaaatctcgcttatttctttactaccgtcattctgagaaatccggatacacacggcttaaatgaagcgaatttcatatttgaccgaaacggaaacatcacaaatccgaacggagatgagttagtcttcgataaaaatctcggcgctcttctgccggccggtgcgatcggaagcggagacgcgataaaagtaacgccgaaaaacgcaaagaagctggctgaaaaggtgcaggccatgactgaggatttgcggacgatgaaaaaagaagcgcagaacgcctatcaggagcacgatgaaaaaatcgccgagctgaaaacggaattttacggccaagtcggacacggcttgtttgatcagcttcaagcacaggacgtgaccaatacaattgaagatattgcgcaatcctacgataaaggaccgattttttacgacacacaggctgagcaggcgtttattgattctttgcaggcggcgatcacggaccttgaagagatcggcggattcttacataaaatagcggacgaatttcaggaaaaagaccagatgctcgcaaactggttaagatgatagaggtggatacataatgccgacattagacgaacttttagaacacaaggacgacccgatgaagaaaaggctgcagcggcagatgctgaaaaccgccatgacgcaggcagcggggacaaaactggaaacagtgcgccaaacgctgaaaccgacattcgaaatggacacattgaaagatgaattatatgaagtgtattcagcactattgaacagctttgaaggcaaggcgcaaaaagctcttgcgcagcggatcagtgaaagtgcgcggctgattgccggcaccgaacataacagagacacattcattaacagtttcaaaacaagataaaataaaaacctcgcagatttatcatctgcgaggtttttcctatcgtcttaactgagacgcgctcggagggattcgaacccccgacagacgtggtaccggaaaccaccgctctatccaactgagctacgagcgcacgttttttcaatcagatacctttatattataataaagaaacgcacagaaagcaactcttttttgattatacacaacaggattatgctgcacgaggacgctgcataatcctgcatcgtttaacggcattgattttcacaaaaaatgtatttcaggcggactgccctcggctcggtacatttccagccgcttcagaaaaagcgataatcacccgtttcagctttttttccaaatgtcctttaacgtccaataggtgaattcctcaacctttacggcgcctttctcagaaaacagctcaatccccaatctgccttcattcggatagatacggcttgtcatcgttgtttctccatgattggcgaatacttcaatcgaggatctgtcaataaagatacgcagcgccagcttgccgtttgcatccagccgcacccttctcacaccgtctttccccatcttggtgcaatcaagtgtcagctttttatccgttagattgtatgtcagcacaagttcttcttcgtcaaggccgcgaatcttaaaacctgccgtttcggcatcagaatcgtttacatcaaacacggctcggacttcaagcaggtcttcgggcgtctttgccaagtaactccctgaaaccgatcgtccggcacattcccgatattccattttccgcagctgcttggtttcttccacgggattcatcaaaagtttatgatcatcacgcaaagtcagttcccgcggcaaagtcagtgcaccgcaccatccgtccgcttttgtcggcatctcagattcccacatatccatccagccgatggcaattctgcgtcctttatcatctaataatgtttgcacggcgtaaaagtcatggccgtgatccagttctttaaaagcgccgtgtgtaaatttgtttgtttcattattatagtcaccgattaaatagccggtttgatgtaaattgttatatgaatcgccgtccgcctcgataccctggggcgaaatcagcaggacatgtttgccgcctaattcaaagaaatcaggacattcccacatataaccgagattaccgtcactttgggcgagaacccccgcgtattcccaatcacgcaaatcaggtgaacggtataaaacgacccgtccgacgttttcttttgaagagttgccgatgaccatataccaaacatcgcgatgcttccatactttcggatcgcggaaatgacgggcgctgtcttccggcggttccgtaataacagggttttcctgaagcttttcaaacacggttccatcttggctgacagcgatattttgagtctgatagaataggtctttctcttgatcaattatattatgtcctgtatagataagggctaatcttccatgatcatcgaccgcgcttcccgaaaaacagccgctttgatcgaattcgtcccccggagctaaggcaaccggcaggtgctcccaatgaatgagatctttactttttacatgtccccaatgcatcggcccccaatgctcatcatacggatgatgctgaaaaaagacgtggtattctcctttaaactgaataagcccgttcggatcattgatccaattcgcccgcggcataatatgataccccaatcgatatctttgtttcactttaccctcggcttccttcaaagcttcttccgcctgctgaattctgtccatttgtaacatcctctctatccgattttttgcagacgctggacacgcctgctgttttgtttcgggcccaataaagtaaatatggagatgacggtaaaaccaaagacgacgaatcccatgatgagataggtttgacggaaccccgcactgtcatataatcctcccgcaagcggcgacagaatcgacgcgcctgcctgagatgcgaattgaaaaccgacgagataaaggacggacgacagacgcgtatcaaaattggcggccaaatatttaaaaacggcgatcagcataatcggcaattccagtgcgtggatgagtttcattgatgaaatgcctacaggctcaactgcaattccggacccgacgatgcggaaagccattaaaaaccccgctaaaatcaaactgtttttcgctccgaacttattgacgataaaaggcgcaagaaacatcatgccggcctccaaaaacacctggaatgaattcagatagccgaatacttggttacccatcgacactgaaggaaacaaagacgcatagtagatcgggaactgctgatcataaacgccgtaaatgcaagtcaccccgataatgtacatcataaaaaaccagaaatcttttaataaaaagagccgccccacatcttttaaccggaccgattccgctctgtttttctcatgatcggtcatttctattttcacggacatgataatggccgttaatatgacggctgaaacagacgcgatccagaagttgatattgggattgatattgaaaagctgccctgcaaaaaatgcagccgccgcccagcccagcgagccccacattcttgattttccatactcgaaatcatacttacggctgaccttttcaatgtacgtttcaatcgcgcctattcccgccaaaaaagcggctcccaaatataagcctccgacaacggcgccaagaaagacgttgtattgtaaaagcggcccatagacgtagatataaaacggacccgtgaatatgagaagacagctgatcataaacaatatctttttcttcagccccaatttgtcagagataaaaccgtaaagaggctgcatgcacagggcaaatacggcgtttacagaaaagataatgcctgtcgctgatccgtttaaattgatttcctgccctaaccaaatcgcaaataaagaatagctggaagaccaagtaaaaaagaaaaagaagaaataagcactcagtttccaatacagactttttgagcttttcatttgcaccgctcctttaataggaccttttaatagtcattttgagccgcatacttccttcttcatattcatcacatacatgcgagctccgagtaagcgcttactttccgccgctgcttgattctttcactttattgccgccagccatctctccatacccgtcacttcccttcactccgtaaataaagcgctttcaaaaagaattgtatgtcaaccggtttcatatgtcaatcggttgacatatgattttctgaatattccaatcaaacaaaacgcaccctctttatatgaaaacagaaacatggaatgtccttgcacatgtcagcctgattctctaaaataagtgcgtgacggaaattgtaagccatttcagtatgcaggagggcacgggaatgaagcctaacattcatgatgttgcgaaaatagcgggagtttcatctacaaccgtttcgcgggtattaaataaccgcggctatatcagcgaaaaaacaaaagaaaaagtgtacaaggcgatggaagaaatcaattactttccaaacgatctggcccgctctttattccgaaaacgaaccaatttaataggacttatcatcccaaactccagcaacccgtttttcggcgaactcgcctttcatattgaaagcatttgtacgtccatgggctacaaactgctgctttgcaacagtttacatcgaaaggataaggaagaaaaatatttggagatgctgataagaaaccaagtggacggcgtgatcgccgtgacttataaccggggaattctcaattatcacaagcagaatctgccgattgtcgccattgatcattacttatcggacacgattcccgtcgtcggctcagacaactatgacggcggaaaaaaggcggctgaactgctgattgaaaaagggtgccggcacatcgtccatctcaacggcccgattgaactcaaaacaccggcaaacctcagaagaaaagcatacgaagacgtcatgcatgaacacggacggaagcctattacatatgaagtacccttttatcagcattaccatgatattatttcaacattattcgatgaacagcctgacaccgacggaatttttgccagcgatgatatcatggcggctgccgtgatgaccgaggccaaaaaacgggggaaagacatcccgaatcaattaaaagtgatcggttatgacggcactgaaaccgttcaatcggttctgccggacttgacaaccatccagcagccgatcgaattgatttccaaaacagccatcgagattttagcaaaagaaattgaaggcgaatttgatgatttgccgctggaaacgtatttgccggtacggcttttggaaggacggtcaacgtagtcagaccgttcagccgtatgtaccgacgcgactgcggtctattttgagcgctccggccatatcattttctcaaggctccggcgctgatcatcctcattttcactttgctgtttgaactttttgttttatgggaaaaatggtgttagaagaaaaggttggcattttggtcagcgttttgtttgacctttattgaccaaaaatgtatcatgtaaatacatacttacctaaaaggtgaaggaggagcattatgaatttaatacctacagtcattgaacaaacgaaccgcggagaaagagcttatgacatttactcccgtcttttgaaggaccgtattatcatgcttggatctgcgattgatgacaacgttgcgaactccatcgtgtcacagcttttattccttgaagcggaagaccctgaaaaagatatttccatttacattaacagccctggcggatcaatcactgccggtatggcaatctatgatacaatgcagttcattaaaccgaaagtatccacgatctgcatcggtatggccgcttctatgggagcatttttacttgcagccggagaaaaaggcaaacgttacgcgcttcctaacagtgaagttatgattcaccagccgcttggcggagcgcaaggacaggcgacagaaattgaaatcgccgcaaaacgcattctcttgcttcgcgacaaattaaacaaagtgcttgctgaacgtaccggccagccgcttgaagtcattgagcgcgatacagaccgcgacaacttcaaatcagctgatgaagctttagaatacggcttaatcgataaagtgctgacacgcaatacggaagaccagaagtaatgcccaaaaaacctgcaagagatgatgtctcttgcaggtttttttatgctttattcccattcaaaaaagtaatgaatgctttgacgacagataattctaacgctgaagaatcatacatgagccaagtatcgcgtatcacaggctcattatttttataggatagcgccaatgtgtataattcatcagaaggctgaagacagatttccggcacaacagaataaccgaggccgtttttcaccatctctttacaggtttcctgcctgtctacctccattgcaatgaaaggcggttcagtaaattggttattccaccatttttgaatcaaacttttcaaagaagcatcagtttgataataaatcatcggcaatttgggaaggtcctcactgttgatttcagtttttgaaataaggtacagcctctcttcattcagcagttgtttttctccttgccaatcataattccccctcataatcccaaggtgtacccccgaatgatgaagcagatccatcaccttcgcactccatcccgtattgacgtggaattgaacagacggatactgatcagaaaaccgttttagaatcgccgggagcttatactgagcaaaattgcttgagactcctaatctgagaaccccgctgacttcatggctcatattgagcatatcatccttcactcttctgaactcctgcagcatctctttcgaataatcaaccagatgttcaccttctgaagtgaactccatccctttttttcttttataaaaaaggcgcactccgaattgtgcttccaggtttttgagccgataacttaacgccggctgtgtcatatataatcgctctgccgccttcgtcatatttttttcttcgaataatgtaatgagcacaatccaatccttttcatccatatgaaatcccccaaaatatttttctgctataaaattttctcctattataaaagttttttattcaactttataaaaattatatgttttacttataatccttatttatcatacgatatcttccaaagggaccggtacctttttatccacacaaaatgatgtaaggatgagacagcatggaaaaagttcctgtaaccgttatgagaggcggcaccagcaaaggcgtttttattcttcaaaaagacatgccagacgatacaaacctatggagcgattttcttttagacattatggggagccctgacgagagacaaattgacggtctcggcggcggccattctctcacaagcaaggcagccattattaagaaatccgccagaaaggatgcagatgttgagtatacgtttgctcaggtcagtttgactgacaaatttaccgacttcaaaggcaattgcggaaatatctcttctgccgtaggcccttatgctattgagaaagggctcgttcaagctgaagagccggttacaaaagtcagaattttaaatacaaacactcaaaaagtgatcgcagcagaagtcgaagtcagaaatggaacatttcattaccagggggactgctctattccgggggttccaggtacagcttctcctatttatctttcatttcaccaggctgaaggagcggtgaccggtaagctgtttcccaccggtcagcctattgatgttctcgataccccgtatggaaatatctcggtatcgattattgattacgccaatccgcttgtctttgtaaaagcagaggacacggggcttaccggcttagaacttccggatgaatataccccggatatattggaaaagctcgaaatgatccgatcgattgcagccgagaaatgcagattcgctccgagacatgaggctgctgcaaaatcaccggccgtaccaaaactgacattaatctcatctccagcggattatatcgatacaaaagggataaagagacacgcagaagagatggatcttgtcattcgtatgatgtccatgcaaaaaccgcatcaagctttagccattacaggggcggtatgtacgactgccggcatgctattgcaagatacaatattatctgaattttcattctccgggagaacgatccgattggggcatccaagcggtattttaaaaaccgaggcagatgttgatccggacggaacaacgattaaagtagtacgcacagcaagaaaaatctctgaaggctatgtgtttactaaacaaagttacagcatgaatacgctcaatcacattggttaataccgtcttcagacaagtcaaagataaacggaggaatacgagatgatcaatgtaaatgcgtctaatcgattaaacagactgcctttttcaagggcccatcaagcagtgctcgttatcctttcattcgcttacttttttgattttatcgatttaaatacgttttcatatgcggcgccttcacttttaaaggaatggaacatatccactcatactatcgcttttattacatctgtctcctatttcggaatgtttatcggcgcctctgccggaggatggttttcagaccgtttcggaaggaaaaaaggtttaattctggttgtcacctttttctctaccttctccctcctctcttctctggcttggaacccagaaatactcggtgtttttagattttttacgagtttaggtatcggcgccacaacgattgtggcgagtacgtatatcagcgaatttttcccatccgcaactaaaggcaaataccaggcaatctgtattacaatcggcatatgcggaattcctgcggccggctgggtggctaaattggtcgtgccgtccgcctcttacggctggcggtttgtctttctattcggcgcggtcggtattttttttccgctgatcgccagaaaactggaagaatcaccgaaatggctggacacgaaaggaaaaagcgaacaagcacaccgcattctgcttgaactggaggcaaaagcagaaaatgaaaagggtgaactgcctgaaccagctccggctctgcaaagcagacaaaccgctgtaaaatccgttccatatcggaagctgtttcaaaagcctttggcaggaagaacttttgttttaatgacgatgtgggcagcttccactattgcaattcaaggctttggcacgtgggttcccacccttctggtgaaagaaggcgtatcaatggatgagtctatcgtatacgtcactctgggaacgatcggtgccccgctgggcgctctcattgcggcgcaaatctctgaccgtgtggatcgaaagtgggccatttctgttttatcgttaattattatggcgcttggattcttttacggcatcaatcctttgccgatggtcattatcgtatgcggatttctcatgcatatgtttgagcgtactttcagttcgatcgcatatgcttatacgccggaattatatccggttgaagccagggcatctggaaatggcctcacttacggcgtaggacgccttgcaaatgtagccggtccctttgtcgtcagtttcctgtattcaggctacggatttttaagtgttttcttattctttacaggctgctggtttctttgtgcactgacagtcggtatatttggaatcggttcaaaaaaacaaaagatggagcaggatgatttcatatcggaagaaactttcgtgcaacaaaagttgtaaacgcatacagtctggaaaccgcaaaacatccatctcctttgaggaaatggatgttcttctttcaaccccaacagcattctcattcgcctcttattctcagacatatctcttattacgaagaaaggcgtggtacgcatgagaaggagaaaagaactttccgtcagaatgaattagatgcagccgccgaaacatatttcagaccgctgccttacaattcacgccatttcttatctaaaatcgggtatgtataccgattcatctgctcaatcagctcatccggccgggaggaactatgtatcagctttaaatgagactcattcgaaaatccttcctggatgctgtacttgaccatcttcatcatcggctcaaaatacccgttcacattgtacagcccgatcggtttttgatgaatgccgatttgcgcccagcacagcacttcaaataactcttcatatgttccgaaaccgccgggcatggcaatgtacccgtcggcaagttcactcattttcgctttccgctcatgcatgccgctgacttcaatcagctccgtcagattctgatgaacaatctctccgctgaaaagcccgctcggcatgacgccgacagcttttccgccgcctgccattaacgcatcagcgacggttcccatcagaccgacccgtgaaccgccgtaaacaaggccgattccctgctccgccatatattcacccagttcggccgctttgcgtttgtactcttcatttacccccgggtttgaccccgcaaatacacaaatggttttcattttttcatctccgcatctatatatgtacatcaataaaccaaaatacactatatattgtcccatctctatatgataatatcaataagaatcatacaggacataaggagtgtttcacatgcagatggctgaagcagaacaatggacgaaagatttttacgaaaaacgaggatggacggcgtacgggccatttatcagaatcggctttttaatggaagaggcgggtgagctcgcccgggcggtaagagcatatgaaatcggcagagaccggccggatgaaaaggacgcgacccaggctgaacgcaggcaggagctgattgaagaaatgggtgacgtcctcggaaatctggctatccttgccgataagtacggcatcacgttagaagatgcgatgaaagcccatcaggaaaaactgatcaagcgctttgaaaccgaataaaaacacggcccgtccgctttttcatggacaggccgtatctgaatttatcccgttatctcgtcctgatgctcaaagaaatgctgtttcccgattttatgaaacagccccgtcttccggatcagctctctcggctgtgattgcaatccgacgatcatcaatctcccgttatgccgtttgatccggttcatcacattccccagcaccgcttctgcggaggtatccatgtaatgcacattattcatcagcagaataagcgtcttcggcttttcctgaagcctctccagcagcgatgattccagtgaatcaattgaaccgaaaaacagcggcccttcaatggaatatgtgctgacggacgaatcatttttaaccgatttgaccgcggcatgcggtgttttaatgcttgttgattcgctcatttttctgataaagaaaacaaaagcgagcacaagaccggcagaaacgccgataattaaatcaaacagaaccgtcagcaaaaaggttgccgccagtacgaatgaatcagtgtttttcagccgcatcatattggcgacttccctccgctcactcatgttccaagccacaaccatcaataccggcgccatgcttgccagcggtacgtgaacggcaagcggggcgaagacgagcaggacgaggaggacggtgactccgtggacaacaccggaaatcggagaaactgcgccgtttttaatatttgttgcggtccgcgcaatcgctcccgttgccggtatgccgccgaaaagcggcgctgccatattggcgatgccctgcccgacaagctccctattgctgtcatgccgtgatcctttcatattgtccgcgaccatcgccgataatatggattcaagtccgccgagaagcgcaatgatcagagccgagggaaacatcatcaccatgttatcaattgagaaatccggaagctggaaagccggaagctgccggggaatttccccgtaagcagaaccgattgtcgccattttgtcaggaaaaaacacgaccgccgcggctgtagagacaagcaacgccacaagcgcgcccgggatcttcggcatcagcctggctgataacagcaaaatggccaaagcaattcccgcgatgaggatgctgtacaaattaaaggttccgatcttcttgcctatttccgcaatgttgaggataaagctttcatgcttttggatatcgcgcagaccgagaaaatgggcaatctgctccgagaaaatcagcaccgcgatcccggccgtaaatccgacgatcaccggcttcggcacgaatttcataatctttccgagcttaaatacgccaaacaggacgagcatgacgcctgccataaaaccggctacaagtaaattctcaaaaccatactgcatcacaatggcaaataaaatgggaacaaacgcccctgtaggcccgccgatctgatatttagagccgcccaacagcgaaatcagaattccggccacaataacggtgtaaagcccgtattccggaccgacccccgaggcgatggcaaaggccatccccagtggaatcgctacaattccgaccacaattcccgcgattaggtctttctgaaatttctgcaaattgtatccctgatatctgccggtaaattgcatcgtcagctgcatcctcctttgactgtttcataaccgtcaacgactacatccagcgtccccgttcccggatcgatcaccagcccgtgcaccggcacctcttcaggcaagagcggatgatacctgaccatattcacgctgtgggccacgctttcttcgacgctgtgaaaaccggtcagccatgtttccaaatcgactcccgcatgctgcagaaggctgagacatttgtcctccaccccgcgctcttttgctttatttaatatggaagccgcatttaatcccgacattccgcactcgcggtgacctatgatgcagacttcctctgcctgcagttcataaacggcaaccaaaatgctccgcatgacacttccaaatgggtgagaaacaatggctcccgcgttttttatgattttggcatcgccgtttctgagtcccatcgcctgcggcagaagctccgtcagccttgtatccatacaggatacgatgacaagcttttttttcgggaattttgtcgtttggtaaggttcatatttcctttcttggacaaactgctggttgtgctccaaaatgcttgataaagaaaccatttttctattcatctcccatccgattgtattgcaagccttcttacccagcttacagtaaggaattatagcacagaaaaaagcctcaaaagcgctttcaaaaaaagacacgataatttgactgtaaattcagattatattcatttatatctttcaaaaataataaaatttatctttacaccaacctataaagcttttgaaaacagcggttccgctcattttgccttcagaaatataggcggattctgttattgtttggagaaatcaagcatgtacatttctttttctttcattttaagttcaaaagaaccagaaatttatcgtaatgcgtttgattatttctcacgttaccgcttctcttatataataaaatagagaagaaagacaaaggaggagaagcccgttgaaaccctatgtattcatcgcgaaaccgataccgcccgaagtcgaacaaatgataggcgagcattgccgctatgacatctggaaagaagataccattccaaaagagaaactgtacgaaaaaatgaaagatgctgaagggctgctgacatccggaacggcgattgacagtgatttgctggatcacgcgccgaagctgaaggtcgtcagcaataattcagtcggctatgataattttaatattaaagaaatgaaaaggcgcggggttgtcggcacgcatacaccgtacaccttagatgacactgtcgctgatctggctttttcattaattctgtcttccgccagacgggttgccgaattggatcgattcgtccgcgccggcaaatggggaaccgttgaggaggaatctcttttcggtatggatgtccaccatcagacattaggaattatcggcatgggcagaatcggtgaacaagctgccaaacgggcaaaattcggcttcgatatggacgtgctgtattataaccgcagcagaaaaccggatgccgagaaggaactcggggttacatataccgacttagatacactgctgaaaacatcagactttgtgcttttaattaccccgcttactgacgaaacatatcatatgatgggagagagggaatttaaattgatgaaagatacggcatgtttcgtcaatatttcccggggaaagacagttgatgagaaagcgctcatccgcgcattgcaagagggctggataaaaggcgccggtttagatgtgtttgaaaaagagccgatcgccgaagataatccgctcctgcagctggaaaacgtcacattgcttccgcatatcgggtcagcaaccgcaaaaatccgcttgaatatgttcaagcaagccgcacagaacatgattgacgccgtatacggaaaaacaccgaaaaacctcacgaaggaatttcaatgagatgaaaaatcccggccgtttcagccggggtttatttttcactagatcaaaagtactattttaaaattctttctattcctttctcttgatgctgatacaatgaaaaggaatcagcttcacatgataaaaatgggaggtattgctttgaaaaaacgattatcgtggatttccgtttgtttgctggtgctgttctccgcggcggggatgctgttttcaacggctgccaagacggatacatcttctcacaaggcgcacactgaagcacaggttatcaacacgtttgacggggttgcggattatcttcagacctatcacaagcttcctgataactacattacaaaatcagaagcacaggccctcggctgggtggcatcaaaggggaatctggcggacgtcgccccggggaaaagcatcggcggggacatcttctcaaacagggaaggcaaactccctgtaaaaagcggacggacgtggcgtgaagcggatattaactatacatcaggcttcagaaattcagaccggattctttactcaagcgactggctgatttataagacgacagaccactatcaaacctttacaaaaatgagataaacacatacaaaaaacggcttccctgcggaggccgtttttttgcagagaatctgcaagcttcatataaaatgagcagtaaatttttcttcaaactctgagcggtctattctgctgttttccgccgtgccatcgtgtttttttattgttatattgcgttcagacagaaccatgtgcccttccggtgtccgcttagaagccagcaggcgtttgttgaaaggagaacgttcatgttcaaagattgtttgtttcatagacttgaggtccttttcatcgatttcttcaagcgaaaatgcgtagcctgtctgccagccgtcccctttgttcatttcaagcacgtatgtcccgaattccgtctcttctatcctcacgcggaacgctccggccgctgataccgtctcgtctcccgacatcggcacaggctgcatggcgagattgaggccgaagcctgcatcagcgatgtactcatttcccccggcggaaagaagtacggccgcatgtgtgccgggcagcgcccagccgtttttccagaccgttccgcggatcaatttgacatcaaatccggcatctttcaggatgaaataaagcagtccgttcaagtcataacaaagaccgccgtgaggttccttcaccatgtgccgccacagtccttctttcgtgacgtcatattcttttttggacaaaacggcgcggttttcaaacggaaaccgatacgcgagcgcctttaaaaactccggcaggttgctgaaatcgagggaatccttttcccagcctatcgtttgataacaatctttcagaaactcattcatcgttccgtcccccttacaaagtgtttacacttcttcctgcacataagcggacaacttttccagcgcttccttttcatcgtcgccttcagcgatcagagtgacttccgtccccgtactgaccgccagactcattaatcccataatgcttttggcattcactttcttgccgtttttctcaagaaacacatctgatgcaaaacgatttgcctcctgtacaaacaatgcagcggggcgcgcctgcaatcccgtctttaaacgcacttccactttcccctgaaccataagatctccccttttctgtacggttatttcaaagtgatgctttgtcctgtacgcagctgttctgcgatttcatcgagctttctcagcctgtgattgatgccggatttgctgattttcccgcttgcaaccatttcccccagttctttcagcgtgacctcctgataatcaatccgcagctgcgcaatttcgcgaagcttttccggcagcgcttcaagaccgatccgttcatcaatgtatttaatattttccacctgtctgagagaagccccgatggttttgtttaagtttgctgtttcacaattgacgaggcggttcactgagtttctcatatctctgacaatccgcacatcttcaaagcgcagcagtgaattgtgagcgccgatgacattcagaaattcagtgattttttccgcctcttttaaatacgtaatatagccttttttccgttcaagcgttttgctgttcagatgaaaatcattcagcagggcgcataatgaatcgttatgttccttataaagcgagaagatttccaagtggtacgacgatgtttcgggattattcacagatcctcccgccaaaaacgcccctctcatataagaacgtttgcagcaccgtttcgccaccagttcctcagaaatattccgttcaaatacaaagttctccccgaggattttcaattcctctaaaatcagctttgcattttcagaaaagcgcacaatataaacattattttttttcagccgcattttttttctgactaacagttcgaccgatacatcatattgtttcttcagcaatgtataaatgcggcgggcaatcgccgcattttcggtttgaacgtcaagcacgagatggcggtttgaaaatgacagggaaccgttcatccgaatcagcgcggacagctccgccttggcgcagcagtccttcacttccagattcgtcagttctttttttgtttccgatgcaaatgacatattagccacctcatttcaaaaggcctctagtcccttaataaatcgacaagaagagaagccactttatgtgtatcgtgacggattacgccatttttatacgtgataatctgatccctgatgacctcaagccccatggatttcagcttttcaacattgaagtcgacgggccgggccagctctttcgcatatttgcttttgatttcgtcagggatctcctcattgttgattaagatcgtgtcgataaacggctgctccatatgatcgttcagcgccttgacatggtcggccgcgctgtattgaagcgtctcgccgggctgtgtcatgacgttgcatatatatacttttttggccgcggccttgacgacttcctctccgattttcggcacgagcagattcggaagaatgcttgtgtacaggcttcccggaccgataatgattaaatcggcctgacggatgacgtcaatcgtttccgggagaggatcaattttttcaggcgtaagaaatacccgtttaatccgctggccgtaagaagggattgtcgattctccggagacgacctgcccgtcctccatttcagcgtgaagaacgacactggtgttggcagcaggcagcactctgccgcggacattcagcaccttgctcatttcggtgacagcgtgaaagaaatcaccggttatatttgtcatcgctgccaaaatcaaattgccgagcgaatgtccggttaagtcgcttcctttgttgaaacggtgctgaaacagattttcaacgagcggctcaacatctgacaaagcagccagtacgttacgaatgtcacccggcggcggaatttgaagttcatcccgcagacggcctgaacttccgccgtcatcagcaactgtcacaatcgccgtaatatcaacgggcttatgctttaacccccgaagcagcacggacagacccgttccgccgccgaagattgcgattttcggcttcttattcatttccggcttctcttttcaatgtcccggtgagtgacatgagtatagaaatcttttttaaaatagtcagccaaatactcagcgagcgtgacggagcggtgctggccgcccgtacagccgatcgcgatgacaagctggcttttaccttcccgcttataagacggaagcataaagccgagcagatcaacaagcttttcaataaacttttgtgtttcgttccacttcatcacataggatgacacttcttcatctttccccgtaagcggcctcatgctttcaatgtagaacggattcggcagaaaccttacatcaaacacgaggtcggcatctatcggaagcccgtatttgaaaccgaatgacatcacgttcactgtaaatgtttcaccttggttcgtggcgaaatgcgccacgattttttcacgcagatcacgcggtttcatatccgatgtgtcatagatcagctgagagcgccctttcaattcttcaagcagctggcgttccagcgcgattccttcaagaggaagcccggtagcggccagcgggtgagaacgcctcgtttctttgtatctcgtcacaaggatagaatccttagcgtctaaaaagagaatgcgcggtgtaatccacggattttccgccatttcatccagcgcctcaatcagcctgtcaaaaaattcacgtccccgcagatccatgacaagcgcgaccttgctcatttttgaacttgattctttcatcagctccaaaaatttcggcagcaaggaaggcggcagattgtcgacgcaaaaatagccgagatcctcaaagctttgaatggcgacggttttccccgctccagacattcccgtaatgatgacgagctgaatatcatggttttcattcatactcatctttctcccccctgcggtctttcttttatttgataagctgcggatctaaacgatagctgagcagctcgaagtccggcgtatacgtaaaggtgccgtgcaaaagcccttggcccttgatcataaaatcaaggatatgcccgtctccgggggccatcggaaggctgtggatatcttttacgtcatgccacttcagaacgccttcctctgattcagcgacattccgccccgtgtaggagtcggcgacgaaagtaaacatcatccactctgacacgatttgttcctgttccttaataataaaggtaaacacgccttttaactgcggatttagtatataaatgcccgtctcttctctgtactctctgatgacggaatctctgacggattcgccgctttccatcttcccgccgggcgcgacccaccagccccgtctcggcttttggagaaggagaacctgatcatctgtctgcagcacacaatttgtcactctttgcacaagtacgtcacctaaccttctcaacaaatcatcgtctcttcattataccgtttcggcatgtctctcacaatgcagagacaccgacatccttttcttttatttgacagaaaacaaaaaatcgcaaaaaaagggcacggatactggaatccgtgccaaagtgtattcattaaaaagggggtcaattactacattcatcttaaaacatcagtatttcacccgtgttacagcgtaattaaaacacagtaacgattcaaaaactgaacattacagtgattatttaacggttttgagcgtttcctcaagctcttccacataatgctgaacgctttgagccgcaatacttccgtcgcctgtcgccgttacgatctggcggagcgttttttcacggatgtctcccgcagcgaaaatgcctgggacttttgtctccatttgggcatttgtttcaatgtagccttcttcatttgtgatgcccaagttttcgaacggtttagaaagcggaagcataccgatataaataaagacaccgtcagctttgaattcttcctcttctcccgtcacggtatccacaagagtaagtctgccgacttttccgttttcctcatggatttcttttacggttttgttccatttaaagtcaattttctcattgtcaaaggcacgcgcctgaagaatgctttgcgcacgcaatttgtcacgtctgtgaacgatggtgacttttgaagcgaagcgtgtcagatagacgccttcttcaacggcggagtctccgccgccgacaacgacaagctctttatttttaaagaacgcgccgtcacaaaccgcgcagtacgatacgccgcggccgcccagttctttttcgccgggaacgccgatctttttgtattccgctccggcagaaatgacgatggcgcgcgctttatattcttttgaaccggctttgaccgttttatattctttaccgtccacgatttctttaatatcgccgtacgcatattccgcaccgaattttttcgcatgttcaaacattttattagaaagttcagggccgagaatgctttcaaaacccggatagttttcaacatcctccgtattggccatctggccgcccggaattcctctttcgatcattaatgtggataagttcgctcgtgatgtgtaaacagcagcggtcatccccgccggacccgcgccgataatgatcacatcataaattttttcttctgacaccatgattcactccttttcgaaatggggcgcaccctatatgactaagaatccccatcaatcgtattccttacccatatcctattaaatctgagggcaattcgctatttttttgctcatttttctgagaaaccgtgattagggagctcctgagcgggtatacaaataaagaaagagccttccgggatagaaggcccttgtcttattcattattgcacgacacgtcttacattgccgttgaatgctttcttccagtaagggttgctcatagaatcaatggatacaccgtgtgatgtattatcgttcaggaacgttccgttacctaagtagatgccgacgtggccgtttgttttatacgtgttgaagaatactaagtctccgcgtttcatgtcagacgcgcttactgctttacctcttccgattaatgtatctgtgtttgtgccgcttgcaggtccgagattaacgcctgcgttagcataagcccagcgtacgaatgaagagcagtcaaagatacggttgtcaatatcggattgagtgcgtccgccgccgaatttatacggagattgacccacaaggcttgatcctacgctgatcgcgccttcaataccgcctgaatttgaaataacagatcccccgtcagaatcatctgaaccgccgctgttatgagatgatccgcctgaagtgctcttcggtttgcttgagctgtcagatgaatcagatgatgttgaaacagccgcttttttcacagttttaaccgccggtgccggctggctgtcatctttttggttttggtcttcagaagctttttgcgcttcttcctgttttttgatcagggcagccgctgcagcctgctcagctttaatgcgcttctgttctttttcagtgtcagctttttggtttgcaagctgtgacgcttcttttttcagatcagagatagcggaagccgcttttttctgaccgtttttcgcttcgtcgaaaagcttgtctttctgatcaagctgtttgttcaggtctttttgcatagactcgagtttcgcaagatcatcttgaacttttttcagcttcacgttaagttcagcctctgcgtcttcgagtttcgctttatcctgctcctgctgtttgatcaggtctttatccgcatcaacgatagaagatactgcagtcgcacgggaaatgaagtctccgaagcttgtcgcccctaaaagtacatctatgtatccttgagaaccgccgttttcctgtaaagaacgaacgcgttttttcaggatttcattgcgtttttcaatacgcgcttctgtttctttgatttcttttttcaaatcagcgatctgctttttcgttttttcgttttcagcttttttatcttcgattttattgcttgtatccaacgctttagcgttaatgtctttcagttctttttcaatcttagcctgtttgtcctgaagcttggacaattctctttcttttgcttcaaggcttgaagccacctcagattgcttgctttcaattttcgcttttttgctgtctaatgtttccgccgatgcagtttttgtaaacgggatcaaaaaactgcttgtcccgatgacggaagccaaaccaagtgttaataaactctttttcactttttctttcctcccttttactttaaacctgttctcatttggaattctattatgaacatcaaagttacgctccctcacatgcccgtgaggctgatgatttttatgtacgattctttgaatctggttaattggtatagattatacagcacatgtaaaataaactaatctcttatgtacgagactcattataccatcatgtttcgacaatttttattacagttatatttcaatgtgattgcaaatctcatattttgcaaaataaacggtgattacggcctgatttcgattcaaaaagcaaaaaaatacgtatgaatacctcttttttcggcggtaaagttctgttttgcccctttctgataaaaaaagaaccgactctttatatagaaagaatcggttttattctaatatatcatctatttgtctgatgtatttcgaaagggttgccggggttataccgtaaacggcggccgtttcttttttcgtcgttttttcgccgtttgcttctttccatacgtatgcgatggctgcggcccatgcccgctcattctgtacggcagcgtcggcgcggatgtgctgaatgacgtgaaaaacccagcagctcatgacgtcagtttttaaactgtcggcttccgctttctccagaagcttgaccgtccgatacgtgaacagcgcgtcaccggagacgcctgaagcgcctttttcaccggaaagcagcagtctgacgaaatcttgttcaaacggtgaaacggcgcgttttgccgtcagaactttttcaagctggttccgctctccttcagcgctgctgatataataggcggcaagccgctgttcaagtgaagcaggcagcggttcctgccgctccgcccaaggcgcgggccggtctgattcgggaaattcggcttcggcctttttccaaatggtttccgcaaattctgtgcggcctgtcccgtaggctgaggcggcaagccagtaataaaacgtttcgtcgccttcgaacccgcttttgtaaagagaacggagccatttataaccgagatcatgtctgccgacaagcgcaagcgtcgcccccagcttatagcgctgttcgaataaaatcggatacacgttggcgagttttccgctcaattctccgactttttcatcttccctctcgtaatagcagaatacaaggaggttgcacagggcatggagattgccttcatttttctcaagcacttcgaataccgtctgtttcgcttttgtaacattgcctgagtaaaagtaagcgagcgccaggttgttgtatgcagaccaaagctcggggtaatcggccgtaatctcttcaagcatgacaaccgcttcatgaagctggccgctctcaagaagcgtttttgcccggtcctgcctgatcagcagctcatcctggtcatagagtgattcgttttcacccgcttcgccgaaatccaaaagctccatcagattttcaatctcttcgctgaattccccgtccggatcggcatctgaataagccgccgcttctttgtatgcttcctgaaagagccccaaatgcgcgaaattattcgctttaaaataatgacactcgggcatttcttctttcaggttcaccaaaataaagtcgaacagctcatttgactgctggtagtggcccatttcagaataaatgacggccagccgtgacagcatttcggaatcattcggctcgagatggacggcccgctgaatcagtttgctggcccgttttaaattccgctctttatatgcttttaagcctttatgaaaaaaatattgtccatcctgaagcagctggacaatttgcgcgtgctttttctgttcagaagtgtgttttcccacaaatatcctccgttttatacgtattaccgtcagtagtataccataaaacggtttcgcctcaatagttcaaaagacaggatcggcttcgttttttactggctggttcgaccagattttagctgtttttttcacgaggctcggctggaagaatgacgcggaaaagggttccttcgccgcgcttgctctcaacctctatcgaaccgccgtgcagctctgcgattttttgggcgatggacaggccgagcccgcttccccctgcgtttctcgccttatccgctttataaaaccgttcaaatacccgctccgcctgttcaggctccattccgattccgtcgtcggcgatttcgacagccgccgctcccggcagatcaacaattttaacggaaatgcggccgccttcaccggtaaatttcacggcattgtgaatcagattcatccatacttggctgagcagcgcttcatctccgtacacatacgactcctgtaaatcaatgagaaactcaatctgtttggcggaccattcaggctcacaggtcaatatggtgcgccgcagctgtttgtcaatgcggaacggttttttttgtatcggttcggtttggcgttcaagcgcagtgagcttcagcagattttcactgatttttgataatcgttctgtttctgtctcgatgatgtgtaaatagcgcccccgctcctcatatgataaatccggttttttcaggaggtgcgcgtagccctttaatgaagtaagcggggtttggatttcatgggaaacgttcgaaataaattcttgtttcagcttttccatttcactcagttccgcggcgagtgtcgacagttcatcagccaatttcgtcacggggtggtcccgttcaatcttctccattttcctggaggcggccgctgtgaagttgccgctcgacatttgcttgatcgtggcggtcagcgaatcccagatcgcatgatgtctttcacgtgctgactttgaaaagataaacatcgttataaacagcaggccgaaaacaagccagagcgtcagaatctgctcggcgtacggcacaagcaaaatcggccatatgagaccgaatccctgaacgatcagatgagccgccagccataagaatgcggtgacggtgagaaggatgatgatttttccagccgttctgaagatccgtttcattctgtcaccacaaaccgatacccgagcccccgcaccgtatggatagcaaacggatagtccttttccggaaaccgttccctcagccttttaacatgcacatcaaccgtccgctcgtcaccttcataatcaaagccccaaatatcttctattaattgttctcttgaaaacgtcttattcggataaccggcgagcttaaataaaagctcaaattcacgccggggcagcgtcaatcccgctccgccgccgcgcgttacggtgcgggattgcttatctaatgtgacatttccgatggtcagcagtttttcagcggtgatccggtaccgtttcagcaatgctttgacccttgcttccagttcaagcggctcaaacggtttgacgagataatcatccgctccggaagtaaaaccttgcactttgtccagcgtttcgccttttgccgtcagcatcaaaatcggaatgtccgtaaagctgcggacggcttcactgacttcaaacccgtccattttcggcatcatcacatccagtatgatgagatcaataggtgctgattcgatcagccgcaccgccgcttccccgtcttccgcttctgcgacgtcaaagccgctctgctccatcatgagtcggacaagctcacggatgtggcggtcgtcatccgcaaccaatatgacagccataaaaatccctccttctgcttttttgcctgtcttcttttaatgaatcgacatgatgtctattaaccgtcttattttttcattgtctcctgtatcgacagacactttttttgtatggcggatcatttcctccgtcacttctttcattacgccttgatcagtatcttcacgagactcccagcgcaaaggaacattgtatacctgaatggtgccgtcaccattgctgctgtaagtgactgacccatcgactaaccgggagcctgctaactgcgtaacatcttcgggatagcgggcgctcgtatgatcgtcagggttgacgtatgccccggccggaatgcggcgaacgttcaattcatctatctgctgattttccccaagctgcagccagatgcgggcatattcaatttgcagaggagaataatctgccgacatgttgttcggttggcttttgtccgcagagatgtgatgtgaacctttgtttacgggttcttttttttctgccgctgatgctgtttcagccttgttgatgccgctgctttctccggccggacttgaagaatggctcggctcttcatcgttaccgtccgtacacccggcagtcatgaatacgagcagtaaggccgcgtgacaataaaaaatctttgtgcgttttttcataatttaacccccgctttctatgaagagaactccggctgcaaaataaaaagcagctttttcagctgctttctattcataaagtcttgctttacacagctttgttttctaagtcggcattcagcttcagctgctgctccgcaaaatcgcggtacagcgaatgggatgccattaattcatggtgtgtgccccgtccggtgatttcaccctgttcgacaaagagaagctgatctgcatccacaaccgtggataaacgatgggcgatcacgatcgtggtgcggccttccattagaacttccagcgcctgctgcacccatttttcagattggctgtccagacttgatgtcgcttcatcaagcatcagaatgctcgggttgcgaaggagcgctctggcaatggcgatgcgctggcgctgtccgcctgacagcataattccccgctcaccgacctctgtttcaaatttcttcggtaagtcttcaataaattgcagggcgtaggccatgtcagccgcttgcctcagttcctcatcagtcacctcgcgttttaatccgtagcagatattgtcgcggatggtgcctgacattaacgggctttcttgcgacacgtagccgatatgctcccgccatgactcaagggaatacgcatcaatcggttcatttccgagcaggatgctgcccgcagtcgggttgtagaatcgttcaagcagcttaaataacgttgttttcccgccgccgctcggtccgacgatcgcggtgactttgccggcctcaatcgtagccgtaatgtcttttaagatggtttgatctgttttgtagccgaatgagacttgttcgagcttaatcggctgatctgcgttttcaatggcttttccggtttggatatcttcttctttttctgcaagaatatgaatcatccgttccgttgcgccgacggatttttgaagctgtgtgaaaaatgaagtgatctggcccatcggcataatgatctgaaacaaatacaggataaaggcaacgagtgcgccggctgtcaattcaccggatgacacctgcatcccgccgtacccgatgacagcgaccagcgccgccattaatacaagtgtaataagcgggcctacgagcgactgcaccttcgcttcacgcagcccgagtttaaagagcgccatgatgcctgcttttccgcgtccgtattccgcttcttcagcgtttgacgcttttacaagcctgatttccgggaggatgtggtttaataatcctgtgaatctcgccgtttcatcctgtgtttcccgagaaattttaaacattttccggccgatcggcactaaaatcaccgcagccagcggaacgacgatcagcacgagcaatgtgagcttccagttcatgaaaaataagatcgtcagtgacccgataacggaaatgattccggtaataaatccgctgatattgtttgtgatcagctcttttaccaccattgtgtcattggtgacacggctgatcgtttctcccgtggcgtttttgtcaaaataagagacgggcagtttaattaatttctgccacaacaaatcacgcagtcccgagatgattttctggccgctgtagttcagggcgtaggtggcgtaggcgcttaatgcggcctgtacgataaacacggctgcgatgattccgatttgcacgcctgacagcgacgacacggaaaagccgtcaacgagctgctttgtcaacagcggaatcagcaggctgacgagcgttgtcacaatactgagagacagcgcgaaggccagcataccgtatgatggttttgtttttttgactaatgaaaagaatgagttgaatttcccttttggttttggttgtttattcggcatatgttttcctcctatatcactgtttatactataacggatgtgcatgaacggaatatgaacaaaacgtatatttttgataaaaaccaaaataaactctattagtcaatattatcaaattcatctgccttcggttgcggaaataaggaatattttattgaatgtttaagtttgacagaataaaaacctcacggatctctccgtgaggtttgtttttactcagatgctgaatggcgtttcgcaaggacgtcaagcacgtcatccaaaggaagcgactgctcacgcagaagaacgagcaaatgatacagcaaatccgccgcttcccattttaattcttcatggtcgcggttttttgcggcgataataacctctgcggcttcctcgccgacttttttgaggattttatcgacgccttcccgaaacaggtacgttgtgtaggctccgtcaggcatctccgcctgccgtttggcgatcacgctttccagttcatttaagatgccgaaacgatcctgcgcgtctgctttttccgtggaaaaacagctgtagcttcccttatggcatgcgggtcctgagggctccgcaagcacgacaagggcatcttgatcgcaatcataacggatggctttcaccttttgggtattccccgatgtcgctcctttatgccacagctccccgcgtgaacggctgtaaaaccaggtttctttcgtttctatcgttttttcataggattctcggttcatataagccagtgtcagcacttctttgcttgccgcatcctgtatgatggcgggtatcagtccggcctcgtcaaaccgcagttcatctgcctgtttcatctcacattcaccccgtgtttcttcatataatctttcacttcttttatagatgtctctttgtaatggaaaatagaagctgcaagcgcggcgtccgcttcaccgactgtgaaggcttcaagcatatggcgcgcgctgccggctccccctgacgcaatgacgggcaccgggacggcacgtgagacaagctgtgtgagcgtatgattaaagcctgttttctcaccgtctgcgtccatgcttgtcagcaggatttcacccgctccccggctgacggcttcttttgcccaagccgtgacttcccgctcggttttctgtctgccgccgtgtgtgtacactttatagcattccgaatcttcgtcatactttgcgtcaatcgccgctacgatgcattgcgagccgaaaaactcagctccttccgtaatcagctcgggacggagaacggccgctgtattaacggataccttgtcagcgccggcgcgaagcattcgtttcatatcgcttaattgattgattccgccgccgaccgtaaacggaatcgccagttttgccgcaacttgttctacgacgtctgtcatcgtcttgcggccttcgtgagaggcggaaatgtcgagaaaaacaagttcgtctgcgccctccctgtcgtaggcttcggccagctcgacaggatcgcccgcatctttcagcccgagaaattgaatgcccttgacgacgcgtccttctttcacatcgagacacggaatgattcgtttcgtgatcatgcgtccttcacccttctgagcgcttcagccaatgaaaattgttttgtatacagcgcttttccgataatcgctcccgatacgccggcgtctttgaagcgggccagtgttttgaggtcggcgactgagctgactccgcctgaagcgatgacgtcttttcccgttgcttttgcgagctgaacggtactttcgatgttcggtcctgacagcatgccgtcagttgcaatatccgtgaaaatgaaggtttccgctccttcggccgccaattcacggcccagatcggccgcccttaccgaggatgtttccagccagccttccgtcgagacatatccgtttcttgcatcaaggccgatcgcgattttgccgccgtattgtttcagcatgctcttcacaaatgccggatcggaaacggccgagctgccgagaatgacgcgatcaacgccttgtgataaataaccgtacacatccgcttcagaacggataccgccgccgatctcgactttgacatcaagctgccgcgcaatgtcaagaacatgcctgtcgtttactttcctgcctgctttcgcgccgtcaaggtccacgagatgaatccattcggcgccttcttgtgcaaattgcgccgccatgtctaaaggagagtcaccgtatatcgtttccttgccgtaatcgccttggatgaggcggacgcatttgccgtttctcatatcgattgccggatataatgtaaaagcgttcatttcttcaccttctgttccgctgccatttttgtaaattgtgttaagatcgccattccggctgtaccgcttttttccgggtgaaactgtgcaccgaagatattgcgtttcccgacgacagccggaacacgaacgccgtactcagcgcttgccagaagatcgccgtcttccatcccgtctatataataggaatggacaaagtaaacgaatccttcttccgcttccgaaagcaaaggagacgtttggtgaaacgtcagccggttccagcccatatgcggcaccttcagcttgtttccttcggcatctctgtctttgagtctcacagcttttccggctaataaaccaagtccttttgcagagccgttttcggtgctttcttcgaaaatgagctgcatgccgaggcagatgccgaggagcagcttaccctcgtcaaccatacggtgtatgaattgatcaagcttcgtgctgcgtaaattgtccatggcgtcactgaatgatccgacacctggaagaataaaagcatccgctttttcaagctcttccggccggtctgatacgacatacgggacgccgacgcgttccagcgctttcgacacgctgaataaattgcccataccgtaatcaattacaccgatcatttacagcattcctttcgtagacggcacacccttgacgcgcggatcaatggatgacgcttcatcaagcgctctgccaagcgccttaaatacggcttctatcatatgatgggtattcgtgccgtaatgaacgatgacgtgcagattcattctcgcttcgagcgccagtttccataggaattcatgtaccagctcggtatcaaacgttccgactttcgcttgcggaaatgcagcgcgcatctcaaggtgcggccggttgctcaggtctacggcgacttgggcgagcgcttcgtccatgggcacaagcgctgatccgtaccgtttgatcccttttttatcaccgagcgcctccaaaaaagcctgccctaaacagatgccgatatcttcagtcgtatggtgatcatctatctccgtatcgccttctgcgtcaaccgttaaattgaattgcccgtgctttgtgaacaaatcaagcatatgagtcataaacggcacatccgtgctgatgtcggcttttccttctccgtctatttcgaaagccagccttatatccgtctcatttgttgttctggcgcgttccgcttttctcatcggtcattcctccgtttctcgcttcaatcgatcttgcgtgcgcttccagcccttccagtctcgcgaaggcggaaatgctgtccgcgtgcgtttcaaatgccttccggctgtaagagatgatgctcgatttcttttgaaaatctgttacattcagcgggcttgaaaaccgcgccgttccgtttgtcggcaaaacgtgattcggtccggcaaaataatcgccgaccggttcagcgctgtatcgtcctaagaaaattgcccccgcgtgtctgatgcttccaagcaaagcctccggcgaatgcgtcatgatttctaaatgctcgggcgccagctcattcaccgtgtccaccgcatcttccatcgattccgtaatataaatgcggccgtgatccctgatcgacgcttcggcgatttctttgcgcggcagggtctgaagctgtttatccacctcatctgataccgcttcggcaagcttccgtgagtcggtgacaagcacgcttgagctgagcatatcgtgttcggcctgtgaaagcaggtcagcggcgacttctttgggcaccgccgtatcgtctgccagaaccacgatttcactgggtccggcaatcatgtcaatatccacaacgccgaagacttcgcgcttcgcgagtgctacaaatatatttccggggcccgtgatcttatctacaggctgtatcgtttccgttccgtaagcgagcgcggcaatcgcctgtgcgcctcccgctttgtaaatttcttttatgccgagctcagaggccgccgccagaacgcccggcgaaaggcgcccgtcttttcccggaggactgacgagaacgatccgttccactcccgcagcgagagcggggatgacattcattaaaacggaagacggataagcggccgtcccgcccggcacgtatacgcccgcggaatcgagcgccgttattttctgtccgagcatcgaaccgtctttgcgatggtaaaaccaagaggattgcagctggcgctcgtgatattctttaatattggcaatcgcctgcctgatcacttccagcagctgatcatcaagcagacggtacgcctcggtgatttcctctgcgctcacggccatccggttcaggctgatgccgtcaaatgtttttgtataggccaaaacggctttgtcaccgttttgtctgacgtcttcaataatccccctgacggttttccgctgctcttcggttccgctgtcgatggaacgcttcagtgaaaaccgctcgcttctttttactgcggttatgttcattttgccgtttctccttccacaacccgtgccagcctggccgccatttcgtcgattacatcatccttcatgcggtagctgaccggattgacgataaaacgcgatgtgatgtcacaaatatgttctgattcaacgagaccgttttcctttaatgtctgcccggttgatacgatatctacgattctgtcagcaagcccgattaaaggggccaattcaatggaaccgttcagcttaatgatttccacctgctcgccctgctctctgaaataactcgacgcaacattcggatatttcgtcgcaatcctcggtgcgactccgttccaatccgccccgggaagccccgcaacggcgagatagcatttgctgattttcagatcgagcacctcatacacgtcacgctcttcctcaagcatgacatcctttccggcaataccggcatcagcgacgccatgctcgacataagtcgtaacatccatcggctttgccagaataaagcggagattttcttctggaacgtcaatgatcagttttctcgattcttcaaactcctcgggcagcctgtatccggcctgccgcagcaacccggccgcttcttcgaatattcgtccttttggcattgccattgtgagtaccttacccattcctctcttcctttctggcaccgataaagtatgtgacgtttgcgaatgattttgtcatatgatcgatattttcaatgcccgccagatcctgcaggacgacttttctgcctctcgccctttcttcctccgcgaataaaatggcctgggcccgctgctccttgctgaaaatcacggcgtccgcttcacttgtttcttcctgaatgccgagcgcttcaatcagcctgtcgatacggagcccgaagcccgtggcgggagcgggactgccgaaatggccgaggagattgttatagcgtccgccgcttccgatgacgaaaccgacatttgccgcgtacacttcgaataaaattcccgtgtaataactcatatggcttattatattcagatcaaggcgaatatgctcggcacatccgtaatcctcaagaatgtcccacaggtcttccagctcctgaattaagctttgtccggagattccgatgatctcctccgccttcgcgcaaatctctttcccgcctcgcaattccaaaagtgcgagcagccggcttttgtctattgaagaaagtggaagcgatttgacatgttccctgtatcccacgtaattcttttcaaagagaaagcgccgcagaacatccgcccgctcggcattacccaaaacctcgacaaacagctcatcagcgagtccggcatggccgatcgcgattttaaaccggtacaatcccgcgtttttcaaagcgccggccgccagcgcaatcacctcggcgtccgcgcttgttgatccgtcgccgatcagctccgcgccgacctgttcgaattcggccggacgtccgccttcccgctcctgagcgcgatagacgcttgccgcgtaccccgctctgagcggatgattgtgtttgtgcagcttagatgccgccaccctggcaatcggtccggtcatgtcaggccgaagcacaagcgtttttccgtcctgatcgagaagcttaaacagctgctgttcttcaatggctgactggacgcctactgtttcatagaattctagggtcggcgtctccataaactgataaccccatttatcaattaaatccgtcagtgtggaacggacttttttcttggcttcgtataaaccgggcagcgtatctctcatgccatgcggtttctcaaacataaacatttgccttttacacctccgctttgtctgaaggaaaattccgaatcctttagttcgctaatatgataatatgttagcagataaaagaatggattgcaacgcccaatgtccgcctattcttttccataaacatggctaaagaatgaacaaacctgtaaacatatcggaacgatcgaatcatattgagcagaagtgctataatacatagaacagcttcatcagaaacaagggagaataattgataatgaagacgcttggaacattatgtgtgctgattctgacagccatccttgtctatctgggatataacatctatacaaacgatattcatttaaattttttcaatcagcagtccgacgagcctgatgagaaaacaccgttaaaagggagcgcgtcaccgctgaatgtcgttctgtacagacagatggattctcccagactgtacaatggctgtgaggtgaccagccttgccatgattttgaacaatgccggatatcatgtgtcaaaaaatacattggcggataaaatcaataaagttccgctcacatacagcagcgggctgaagggagatccgaatgaaggatttgccggagatatggaaaacggcccgggtttaggcgtttatcatgagccgattgataaacttgccaaagaatatgcgggaaacaaagtatacgatcttacgggaaaagacatttcttcagtgtaccgccagcttgaaaaagggcggccggtctgggtgattaccaccacatcctttaagccggttgatcatatgcagacttgggatacgccgaacggaaagatcgacattacgttcagcatgcatagcgtagccgtaaccggttatgatcacgattatgtttacgttaatgatccttacggctataaaaacagaaaaacagaccggtctgactttgaaaaagcctggaagcagatgggcagccaggccattgtgatcaagtcataaaaaaaccccgctgacgttaatctgcggggttttccattcgttttttcatttcttcgtgcgtataaatcacctgcatcggatttcctccgacaaacgccccggccgggacatctttgtgcaccagcgtgccggctgatacaacggctccgctcccgatggtgacgccgggcagaatggttgtgtttgccccgatcatcacctcgtcaccgattgtgacaaaaccggtccggtactcatgtattaaatattcatgagccaaaatcgtcgtattgtagccgataatgctgttttttccgacagtgattttttcgggaaacatgatatccggcatcaccatcagcgcgaatgacgtctgttttccgacattcattttcaaaaaggttcggtacagccagtttttcacgcttaaaaacggcgtataccttgcaatctgaatgatgatgaaatttttcatcaccttcaggaagggaaccgtctgataaacatgccacaatgaatttgcacctgaaacaggatggcggtctgtttttctcacgggttacttcactccggtgatgtgcaataaatcactcattttctcgagcatataatcgggttcataggcggaaagcgtctgtgcgcctttaatcgtccacgcgacgccggctgttttcgtgccggcgttttttcccgccatgacatcgtgataattgtcaccgaccatgatggcttccgacggatcgcacccaagccggctgagcgcaagccgcacaggctcggggtcaggcttcggctgcttaacatcatcaagcgtgacgacagtatcgaaaaacgccccgatgcctgtcagcttcaatcccatattgactgtatccctcagcttagtagtgacaataccaagctgatagcccgcttttttcaattcatccagcgtttcataaaccgtttcgtactccgtgacgagctcatcgtgcttttcatggttgaatgctctgtacatgctgatcatctcatcgcacttttcggcattaatgcctgaaaacgtttcgtacagaggcgggccgataaacggaagcacatcttcccttttaaactgccccgggcaataatgatcaagcgtatgaaggtaagaagcgataatcagttcattcgtgtcaatcagcgtgccgtcgagatcgaataaaatggcggttacatgtttatcagtcatcttatgtcctttccgatttcagtcgtcagtccgtgtcagcataccgcttatcggcataccccttcatgcgtctgaaaatcattaaaataatcgcaagtacaatcagcacaatggaaatgacctgcgcgatccgaagctggctcgtaagcatcaggctgtccgtccgcattccctcaataaagtatctgccgattgaataccagatcacatacgtcaaaaacagattgcccctgcgcaggttcacgcggcggagcagaagcagaatcacgacgcccgcaaaactccacagcgattcatacaaaaacgtcgggtgataatattgtccgtctatgtacatctgattaatgatgaaattcggaagatgcagactttctaaaaatgaccggctgaccgctccaccgtgagcctcctggttgataaagttcccccagcgtccgatggcctggccgagcagaatactcggcgcggcaatatccgccagcttccagaatgagatgcctcttacttttgaaaagacaattcccgttgcgatcgcgccgattaatccgccgtgaatcgcaatgccgcctttccaagttttaatgatttccccggggtgttccgagtaatagctccactcgaaaagcacataatatgcccttgcgcaaatgattgcgatcgggatggcgaaaagaacaagatcaataaaaatgtcctttttcagcccccgcttttcactctccctcatggccatccaaagccctaataacgcgcccgcgccgataatgatgccgtaccagtgcacggataaaggcccgagctgcaaggcaatcggattgattggtgttccagcttcattcatattattgccaactcctattcgtcttgttcgccgtcctcaatgacatccgccagcttattcgtgaattgttcggcagcatttaagcccatccgcttcaatctgaagttcatcgccgcaacttcgataataacggcgagattccgccccgggcggacgggaatggtcagttttgtaatttccgtatcaatgattttcattttttcttcttcaagtccgagacggtcgtattgctttccttgctcccaaagctcaaggtccatgacgattgtaattcttttattgcttctgacggcgcccgccccgaacagcgtcatgacatttataatgccgagccccctgatttcgagcagatgctcaatcagatcaggcgcgttcccgacaagggtatcctgatcctcctgccggatttcaacgcagtcatccgcgacaagacgatggcctcgtttgacaagctccagcgccgtttcacttttaccgacgccgctttttcccgtaatgagcacgccgacgccgtatatatccacaagcacgccgtgaatggccgttgtcggcgcgagacggctttcaagaaaattcgtcagcctgcttgacagcctggttgttttcagaggggatctgagcacaggcacgccgttttgctcggaagcttctacaagctccggcgggatcggcatatctctggaaagtatgatagccggcgtcacatcggtgcacagcgatttcatccgctgtttcttatcttcctcgggaagctgatcgaaaaatgacagctccgtttttcctaaaagctgcacccgttctctcgggtaatatgtaaaataaccggcgatttcaataccgggccgtgataaatcactcatcgtaatcgggcggttaatcccttcttctccgctgatcaattctaaatggaactgttccattacgtctttggtccgaacctttgccaagatatgttcctcctgttctgggatgttccgagctttgaacagttatattttatcactttaccgtctgaaccaaaacagatttatacaattccggcataactggtctagataactagtctgaaaaggagtaaaataaaactaacaactaaccagaaaggcgtgttttaaagtggctgaaagcttgttaatcagcggtgcggacatcgtaacagaaaaagaaatcatccgaaacggttttctcggtataaaggacggcatcatttcttacgcgggaaaaacaaggccgcaagaaacgtatgagaaggaatggaaggcgcccgagggttcgtatgcgcttcccggaatgattgatatccatattcacggcggatacggtgcggatacgatggatgccgatgttgcggctcttgatacactgtccgcccggctgcccgaagaaggaacaaccgcttttttagcgacaacgatcacacagcagcacgaaaacattgaaaaagcgctcatcaacgccaaaaaatgggcgtattcctcaccggagacccaaaaaggcgctgagttgatcggcattcatttagaaggaccgtttgtctctccgaaaaaggcgggagcacagccgaaacaatggattactcctgctgatgccgggctctttcagaaatgggagcggctctcgggagggctgatcaaaatcgtgacgcttgcgccggaagaagatcctgatttcagcctgatccgttatttaaaaaaccaaaacatcatcccctcaatgggacacacagacgcaggagccgagcttttacaaaaagcggcggatgccggggcggtgcatatgacgcacctctttaacgccatgagctcctttcatcaccgtgagccggggggcatcggcacggctctcgcctgcggccgcatcacggcggagctgatcactgacggcattcattctcatcctctggctgtaaagcttgcctatttggcgaaaggaagccaaaatctgatcatgattacagactccatgcgggcaaaagggcttaaggacggagaatacgagttcggcgggcaaaaagtcaccgttcgcggggacacggcgcttctctctgacgggacgctggccggttccattttaaaaatgaatgaaggcgcggcgctcatgcgcaggtttacaaactgctcatggccggatatagcaaatatgacatcggcaaatgcggcccgccgcctcggcatattcgaccgtaaaggaagcatcgccgaaggaaaagacgccgacgttgttctgacggacggaaaatgcggcgtgctggccacgatttgccgcggaaacaccgcatatatctcaagggaggctgattggacatgaatgttatcacatgcagacattatgaagaattaagtgaaaaagccgcagcgattatcgctgaaacagtgaaacaaaagccggatgccgttctcggccttgcgacagggggcactcctgaaggcgtatacaaagaacttgtgcggatgcaccgctcagaaggcttgtcattccggaatgtcacgacgatcaaccttgatgaatacgccgggctttctcccgaggacaaaaacagctatcattattatatgaatacacatttttttgcacatatcgacagccgaaaggaccgccactttctccctgacggacgggcagacgatcttgatgccgaatgcgggcgctatgaccgattgattcaaacactcggcggagcggatatacagcttttaggcatcggacacaacggccatatcggctttaatgaacccgggacgccatttgaatcccgaacccatgttgttgagctgaatgaagagacaagacaggcgaatgcgcggtactttccgtcaattgatcaagtccctgaaaaagccctgacaatggggatcgggacgattttatccggcaaacggattctgatcatggcatccggaaaaagcaaggtccaagcggtgaagcagcttctggacgggcgcgtcagcgaagcattccccgcctccgccctgcacgcgcatccggatgtgacggtcttgattgatgaaaaggctgcgggcggcgattgaaaggatttgacctatgcagattgataaacaatctccgattccgatttactttcagattatggaacaattgaaaacacaaatcaaaaacggcgagctgaaagcggatgcgctgcttccgtcggagcgggaatacgccgaacaattcggcatcagccgaatgacggtgcgccaggcgctttccaatttggtgaatgaaggatttttatacagacagaaaggccggggaacgttcgtcagcaaactgaagatggaacagccgcttcaagggctgacaagtttcaccgaagatatgagaagccggggcatgaagccggggagcagacttgccgaataccagctgattcaggcgacggaagaattatcttctatcctgggatgcggctatccggcaacgcttcataaaatcatccgcgtccggctggcaaatgatatcccgatggcgattgaggcatcgtatatcccgtttgacaaggcgggaaaattggatgcctcccattttcaatcatccatgtatgagcatattgaagcgtacaatcagatgccgatctcacgggcaaaacaagagcttgaaccgggaaccgcttccgaggaagaagctgagctgctcggtatccagcccggcgcccccgtcctctatatcaagcggaccacttatctgcaggacggcactgcctttgagcacgtcaaatccgcctacagaggcgaccgctacacattcgtgcattatatggacagggtgaaatgaaacatctccaaccgttacgggttggagatgtttttttgatctgccattttcaaatcaagccggtgaatgttctctatgactctatcaaaacgaagaggctggggtcccggtatctatttttataaagaaaagagtaataaaatgctatcctctgttttgtacaatatacggaacctgctttgaaatcagcagcagcggttctttgtttttatgagccaatgaaaacatgattgcgccttcaatcatcgagttgattgtcatcccaagcttctccgcttcctcttgttcaaacccatgctcaagaaattttgccgcaaacacatccgtccacttcttgaacacctcaacacatgtgcatcttaacgtttcattgatcagagcggtctcacccgccagcaatccaaccggcacgccctcaatattctgcggatcattaaactgttcagccgttacatgaataaagtgctgaatcgcttctacagggtccgcggattgagacatactattctgtatctgcttttcaacgcatcttcccgtatatttgatcgccgcaatggcgagttcttcttttccgtttggaaagtgatgatacactgaccctctgggtgctccgctctcttttataatttgattcaaaccagtcgcatggtatccctgaatctgaaaaagatatgcagaggtttgaataattctttcttttgtcccggttttactgttcattatgtttcctcctgcatattacgaaaaccaatcgattttagtatagaaaagggacataaaaaagtcaaaaacacttagtaccgccatgcatgttacagaaaaaaacctgctgaccgtcagattttcttctgaccgatcggcaggtgtatgtttttgctatgggtttgaggcatgcctgaaatcaaactgatccggagccgggtgatacggcgtatttcccgttttgaacatccacagcggtgatattgttttgccgttgtacgggtccttcacgacggtgtaccagtaataaacggaatcaggctgcaggccgtcccagacccaatttgcggtttttccgctttttacgtgttttttatgaccgagcagttcgttcgtataaacgttgcattcaaaataatcagtcgctacccttttcctcttcggctgtaaatccatttctgctgagaattcgtctttatcagcgaacagatcggtgtcatagtaattgatgtcatccgtgtacggcgagtaggagaacatgtgaacctgattggcggcctgatcaaattgcattatgcgcataaagccctgccccccttccggaccgtcctggtagtcggtcagaatttggtggacgaggcggtccggttttccgtctccgtcatcgtcaagcgcatcggtttttttcatggcgttatggtaatggccgcttaataccatcgccacattgcgattcggcttgacgacttttcgatagatcgtctccccgatcgggcttcgatttccgctcacaagcaagtactcatgaaagcataagatggcggttcggtccggatacctcttcagcacttgattgatccagtcaatctcttgttccgtaatgccccagcccatataaatcataataaaatcgttcccgcttgccgacagcagatcataatgcccgcggttatttttgtatgatccgccgtaatgcatgttctgttcaaaccggcggctcccgaagaaatccccgaaggttcggtatgtgccgtctttatggccgacgtcgtgattgccggcaagcactccgtacggaatccccgccttgtcaagcgtccgcatggagtgatcggcgtttttccactgtttcatcaccattgaatcatcgacaatatcaccggtatgaaagacatatttaatattgtgcttttccttattttctttgatccactccgtcattttgtcaaaaatgtgcgggtgcccttgtgcgtaatactgtgtatccgacatccagacaaacgtgtaattgcctttcgccggtatttgatcctgcacgatgacattcatttttgagttcttcaccacatccgctgcggaaacggcggcttttaatgtaaacggctttttatctttggcaaggacgctgtccgcctcctgccagcggcttgtccggtaattccaaatatacatggttacctttcggccgggcagagagcttcctttccagaccgcctcggccagatccgtttcgtcgatagacgggtcaacggagacttcgaaccggtgataaggaaaacgctccatactttccgccgaaacggtttttccgtcatttgccgagatacggttcatttccggcagggtaaacggcatttcattttcttttacacccttcggcggttccgttaatgaggcgtgtttatacactttcacgctgcccggattccgcgcggtataacggaagccgcgataaaatgatacattcatgtcatccatcgtcgggtcttttacccggacggacagctttgctttgcgggcgccgattttttgaccggcaagctccggctggttcggctcctcccgtttaatatggaaggtgcggacggacgttgtttcatttccggcaaggtctgccgcaatgatagtaagggtgtgctttccgggcttgagatcggctgatgacgtgtgatgcgggagcgtaatgctttctccgtccaaaaacgctttcacctcttccactttgctccatttatcacggatgtccgcattcagctcaacattacctttcagcgccgcgccttctttaatacccgggacaatcttcggccccgaattgtccaccctcacagattggctcagctgctcctcaccgtcactgacaaaaatatggtgatagccttccgaaagcttcgccgtgttccacggcagcagccgtgacgtaaacaaatgatccggcaggctgaatgagaaggtcttctgctgatttgcccgcctgccgtcaccgataaacagctgctcggacgggtccgtcttcccgtctttgatcaccgttccgtccgaaagcaccagacgggcatgtttcacgacaaaatcatcccgattctctcccgtgtcatacggagaaacctttgagcccgaacggatggatactttctgtgttttgcccccttttagcagcagacgttccggaagcagaaccgagtgcgttctgtagcggtgagacggatcgtcaaaaatgtgcagcacctcgttttccatcatgacggtgttttgaaaataaagattcgttttccgggcatcgaaggcgaaatagacctctttttccagcgccggccgggtctcctgccgcttgccgtcaatccacagcttgatctcatcggcgctgacgtcggaagtcgctttgagcagataggtgccggatatcgtatcttccggttcaacattcattctgagtccgtgtgatttgctcgtctgttcaatgtcaatcatcttgacgggcgtttttgcttcattttctccatcactggctgcgatataatactcaagctgatcctggccgagcagttccggggaataaagaatgtgatggtataagctgtcgttgcggtctttttcggccagaattcgtttgaatggttttttctcattggtccggtaataaaacgcggctgttttgacaaggtttttgtcttttatgtcagcctttaattcaatgctttcagcgggccggacgggctttctgtctgtaaggtcttcgatgaccggtttttccttgtccggtttgatcacccttttctgctgcggaatctgcgcctgaaaaacggagcccggtgacggcttatgctcgctcgtggagatcttcagcaattctcccgttccgttcagcggatatttgtacagcaaagaagtcagccggcggaaagcgtgtttccggtattgcgctgaggcgatatccttgccgatatttgccgacagcacgaccgtacgcgggcggccgttggacattccgtctgtcccttcgatgacggcgagatgttctccttccttcagacgtgtcccgtaatagcggttgaaatcatctatcgtcagttctgatgcggcgcgtctcagccaaaacacgtaagtcccgcctgacggaatgacggtatcttctttcggcctccatatcatatctgattccggcccttccttcggatagcggtagcggatatgatagtctttaaaatgaatgggcctgtccgtcgtgttatacacctcgataaattcataggcatcagcgccgtcttcatttttcgtatcaaccgcaagctccgtaatcatcagctcgggaatatgattcaaatcggcttgatagccgtccagcttcagccgctttttctccgattccgcccgctgtctgccgttggtgaaaacgaggtaatattccaattctccattccagatatcccgttttgaaacctgggccgtaaaaagccggattgcgcctggcgcgggctccatcggcaccatcttaaaccccagctcattgctttgtttataaaaaagaaacgccgaaaacgcttgatagtcagcattccgtacatgagcctgtatgaacaggtttcttttcatttccgcctttacttcgatttggggaggattctccagaagcggtatgtaatgaggcggctgtccgaattcctgctgattcacggggatcgccgattctttgcgcgccgcatccgcagaaggactcacacaaagcaaaccaatcagaaaaaagagcgtcatcacaagtttcatctcattacctccctatgcattatgttgcgtcaggaggctgccgcttatgtaaaccgcacataaaaaagctgccctctcgggacagcttgttttttatccttttctaagcggctccaatatgcctttttggatcagcaagtggaaaacggacagcacgacggatgcccaaatggcggtgccgaacccgtcaatctgaaagctgtctcccatcattgctgcggtcatcattaacgtaatggcgttgatgacaaacagaaagaggccgagggtcacaaccgtgaccggcaatgtcaatatgacgatgatcggtttgatcagcacatttaacacagaaagaatcacactggcgatgacagccgctccgatactgctgatatggacggaatcaaaatatcccgcgataacgattaataataaagcatttactaaaatgctgactgcccatttgatcatttatttcaaatctccttctaatggtacaacaaaacaccagataatatatacaatcggcacgattccgctcgtgacaagcgctaatacaacggtgataatgcgcaaaagcgacgcatccatattgatgtactccgccaaaccgccgacgacgccggcgattttacggtttttttctgaacggtaaagtcttttcatccaatcacctctgagtatgcttgagcttaatggctcctgttaacgattctgagaaaatcgagagatgctgatcatggccttgatttgatgccagcatcagttctttttgaatggtatcattcttttcctttaaaatttccgcatcaatcagctcatggctgagagagccgagattgcttttgagctccgctttcaccgccgaatcatcaggcagggcgatctccacgtttccggtcgtcgttttcgtgtagatggagcggcagtgcggcgctgtcacggtaagcatgatattgccgttaaagctttgaacgtcaatggattcactcgatccgcgcaaatcaatcaagccgttgatcgtttccgcttcaatcgcgccgcattgatgtccggccagcttgatttgtccgttagccgtttccgccgacgctttctcagccgtcaaatgagagaatgacagaacgccgtttgtcgttttcgccgagaattcttttacatgtaaatgttcccctctgatcggtccgttaaacagcttcactcttatcttatcgtactctttctggggaacataaagcgtaacattggttttcatcgttttcttttccgtgcggacaaaaaacttattgcccttcacttcacactcaatatgctgaagaaatgcggtgcgcgccgcctcctgactgtccgcccggtacactttcgcctggcactccgctctgatatcttcatccgcccacggcacgatattgacgctgccgtttgcgatctgcatatcaatggccgagaattcactgtctttaaattgaaaaatatgctgcacttcgtgtgcgtggccgaaattcagatcaagatccgcttccttcacttttttgacggcagaatcaatccagtcgaacagcttcgccccgagcgacggcttttggcttccttttgcaccgctttcgaaatcttccgcaggttcctgaacttccgcagataacgcggtgatctgatcttctttttctttatattcatgatccagtttttcaatgagcgtcagtgcttcctgcgccgtcagcatgccgtcttccacaagctttaaaatccgttctttctcctgtttcatacaaaactcctcccccgacttttcttacacctggcgtaacaccttaattccctgcacgatattccaaatgaccattccgatgaggatcagaaaataaacagctgctcctgttatcataacaaaaacgggcaccatactctccccctgggccgtaatcaatccgccgacaacaccggcggtcacaatcagcaagcccgcaaacggaatgatatgggaaatcagagcacgcatggcatgccgcttcgtctctttttcatcgacgacaaagtaagccacaatcggaagaatgagcggcgcgagaaacacgctgaaataacagattgatgcgataatcgcttgatttcggttcaataaaaacactccctgtgccgtgatataaaaaaccattccttatacatacgtatgacgaaggagcgggtttcattttcatgctaaggacatgcttcgttatacgtaatttttggtttcagagatttcactatagaatcttttccccgaaccgattacaatatgtaacaaagcctgaccgtatgcaaggaggacatacaaatggagaaagatcccgaaaacgcccaagtaacggaagagagtcttcgaaatttaattcgcgaacagaaaagaatgaacagcgaaatgctggctgaattggaacagatcaaagcagcccctcttcccatttcccatgatatccaatatataaaagtgctgctggacagcagcagcacccatattctgcaggacttaatgcatttaagcagacagcttccccaacagaaaaaaagcctgtaacaacaacagcccaaaaccgataagttttgggctgtttttattgatctattacgtggctgccgtttctttttcggccagcaatgttttcatccgttttttatcgcgttccattaccggtttcagatagcggcccgtatatgattctttcacttcgacaacttcttcaggcgttccggaggctacgatcgtgccgccgcccgctccgccttcaggtcccagatcgacgatgtagtccgccgttttaatgatatcgagattgtgttcaatgaccaaaacagtatcaccgttatcgacgagtctttgaagcacaaccaaaagccttgcgatatcatcaacgtggaggcctgtcgtcggttcgtccagaatatacagcgtccggccggtggaacgcttatgcagctcggaagcgagcttgacgcgctgcgcttctccgcctgacagcgtcgtcgccggctggccgagcgtcacatacccaagtccgacatcagcaagcgtttgaagcttgcgtttgattttcgggatattttcaaagaaagacagagcatcttccaccgtcatatccagaacgtcggaaatgctttttcctttgtatgtgacctcaagcgtctcccggttgtaacgtttgccgtggcacacttcacacggaacgtacacgtcaggaaggaagtgcatctcaattttgatgatgccgtcgccgcggcaggcctcacagcgcccgccttttacattaaaactgaaccggccttttttatagccgcgcacctttgcttcatttgtctgcgcgaatacatcgcggatatcatcaaacacacccgtgtaagttgccggatttgatctcggtgtccggccgatcggcgcctggtcgatgtcgatcaccttatcaaggtggtcaaggcctttgatctctttatggcttcccggtttcgctttggctttatgaagcttttgcgcaagcgccttatgcagaatttcattcacaagcgtgctttttcccgaaccggacacacctgtcaccgccgtaaaagtgccgagcgggaatttggcgttcgcttttttcaggttgttttctgaagcgcctttgatttcaatgaaccggccgtcaggctttcttctctccggaggcatcgggatgaattgagcccctgacaaataacgtccggtcagagaatccgcatcattcatcacttcttcaggcgtccccgccgatatgacgcggccgccgtgaatgccggcgcccgggccgatatctatcaagtaatcggcagccatcatcgtatcttcatcatgctccacgacaatcagtgtattgccgagatccctcatgtttttcagcgcgctgatcagacggtcattgtcacgctggtgaaggccgatggacggctcatcaagaatgtacaggacgcctgacaaacgggagccgatctgcgtcgcaagcctgatacgctgggcttctccgcctgacagcgttcccgccgccctgctcagcgtcaggtaatcaagaccgactttatctaaaaagctgagacgctccacaatctctcttaaaattaaatcggcaatctgcatatctttctcagacagcgtcaggtttttgaaaaattccagcgcatcgccgacggaaagctcggtaatggtgccgatgtggcgcccgttgaccaaaacggcaagcgcttctttcttcagccggtagcctttgcacgtcgggcacggcttctgtgacatgtactgctccatctgttcacggatataatcggagcttgtctctttataccgtctctcaatattgcgcagcacaccttcaaattcaatttcattttcgcgcacttgtccgaaatcattctcgtatttaaagtagatccgttcattgccgctgccgtacagcactttatcaagctgatgcttcggcaggtctttgaccggagtctccatatcaatgccgtaatggcggcagaccgcctgaagcagctgcggataatattgtgaactgatcggcgtccacggcgcgatggcgtgttcctttaatgacagttcaggattgggaatgacaagctcagggtccacttccagcttcaaaccgagaccgtcacaagtcgggcaggcgccgaacgggctgttaaacgaaaacagccggggttcaagctccccgatagaaaaaccgcacagcggacaggcgtgatgctcgctgaacatcagctcttcctgaccgatgacatctatcatgacacggccttcccctaagcggagcgcggtttccagtgaatcggaaagccgggcggcaaccccttccttgacgacaatccggtcaatgaccacttcaatggaatgctttttgtttttttcaagttcaatatcgtcggaaagctcggccatttctccgtcaatccgcacccttacgtaaccttgctttctgatttggtcaagcactttgacatgggcgccttttctgcctgagatgatcggcgcaagcacttgaagcttcgtccgctccggatattcaagaatccggtcaaccatctgttcgatcgtttgcgacgtaatttcaatgccgtgctccgggcagtgcggcttcccgactctcgcgtataagagccggagataatcataaatctccgttactgttccgacggttgaccgcggattgcggctcgtcgttttctgatcaatgctgatcgccggagaaagcccttcgatcgcatcaacgtccggcttatccatctgccctaaaaattggcgcgcataggcagaaagcgattcaacataccgcctctgtccttccgcgtaaatggtgtcaaaggcaagggatgattttcccgatccggacagccccgtcacgacgacgagctgatcccggggaatcgttacatcaatgttttttaaattgtgcgcccttgcgcctttcacctcgatccggtcaattgccatgtgttcatcatccttccgctttaagctctaacagtaaatcacgaagctctgccgcccgctcgaaatcaagcgctctggccgcttctttcatttcgtgctccatttgctcaacgactttctggcgttctttcttcgtcatcttcgccagtttaggcgcggcttttgttttatattcttctttatcctcagcggcctgcgtcgcgcggatcacatcgcggatttccttattgatcgtttgcggcgtaatgccgtgaatttcgttaaagcgctcctgctgttcccgtcggcgcttcgtttcattaattgcgatctccatcgaattcgtgattttatcggcatacatgatgacgcggccttccgcgtttcgtgccgcccgtccgatcgtctgaatcagcgaacgttcagaacggaggaagccttctttatccgcatcgagaatggcgacaagtgacacttccggaatatcaagcccttccctcagcaggttgatgccgattaacacatcatgttttccgaggcggaggtcacggatgatttcaatccgttcaagcgtcttaatctcggaatgcagataattgaccttgatgccgatttccttgagataatcggtcagatcctctgacatttttttcgttaaagtcgtcacgagaacgcgttcattccgttcaatcctcgcctgaatctcgccgatcagatcatcaatctgtccttcgatcggacggacgtcaatgaggggatcgaggagtcccgtcggtctgatgatctgctcgatcatttccggcgtatgctcaatttcatacggtcccggagtcgccgacacgtacacgatattgtgcatatgcttttcaaattcctcgaatcggagcggacggttgtcaagcgctgacggcaggcggaacccgtgatcgacaagcacctgttttctcgcctggtcaccgttgaacatgccgcgcacctgcggaatcgtcacatgtgattcatcaacgacaatcataaaatcgtccggaaaataatcaagcagcgtatacggcgtagagcccggcggacggagcgtcaaatgtcttgaatagttctcgatccctgagcaaaaacccatttcccgcatcatttcaagatcatatctcgtccgctgctcaagccgctgcgcttcaaggagcttgccgttttcgtgcatcactttcaagcgctcctcaagctcctgttcaatattcagaatcgctttttccatcttttccgcccgggtgacgaagtgggaagccgggaaaatcgcgacatggtcacggtcgccgagaatttctccggtcaaagcgtcgacctccctgatccgctcaatttcgtctccgaaaaattccactctgatacaatgttcgtcacgggaagccggaaagatttccacaacgtctccgcgcacgcggaacgtcccgcgctgaaagtcgatatcattgcgggcatactggatatccacaagctttctcagcagctcgttccgctcaatctccatttccggtctgagcgacacgaccatttcccggtattcttcaggcgaaccgaggccgtatatgcatgacacactcgcgataatgatgacatctctccgttcaaacagagaggatgtcgcggagtgtctcagcttatcaatttcatcattaatgcttgcgtctttctctataaaagtatccgtttgaggcacgtacgcctccggctgatagtaatcgtaatagctgacaaaatactcgacagcgttgttcgggaaaaactccttaaactcgctgtacagctgtccggcaagggttttgttatgggcaatgaccagtgtcggtttgttcacttctttaatcagattggacacggtaaaggttttgcccgtccctgtcgcacccaggagagtctggtgttttctgccttcctgtatgcctttgacaagcttctcaatcgcttgcggctgatctccctggggctgatatttcgagactaactcaaaacgatctttcacaaaaaagcctccgtttctttacgaaatcttcctattgatatagtaacacaatgacgggcaaaatcactaaaaatacgaactaaagttcgatggtttatttttaccaagtcaatttttgtataaaaaacctgcttttatggcgtaaaagcaggcattctatttcatattcaccatgtcaggcattgtctttctttttgtctgcttcttttttggccatgtacagccctccggccaccagcgatacgacatccaatccaacgataaaatacgtttcggtgtaaccctttaaataggatgcgaaaagcagtgcggctgtgagagcgatcgccacatagtggttaaacgtgacgcgcgtaaaaaggacgaccagcataaaagggaaacataatgcaaaaacggcttttgtaatcacaaaaaccctcctcgggaattcttcatctcatctgattatagtaaaaaatgaagaatcggacaatcgttcccctgctatcacaataccctttttcggcagtcttcaatcatctgtcaaagaaaatgtgaatataaatccattgaaccattaaccagatgaatcaaattacctttcttcagccgaaaggatgagaaggtttaggcctttgtatctttgacagtttcttcctccctctttacaatgtaatgatagtgtttactatcattttcttggatgaagaaaaaaagggggtcataccgcatgtattcagtgcgatttcaaaaagcggaagaatcgagccgctctgcaggagcaaaaggaatgaacctgattaaactgacgaaaaacgggctgcccgttcccggcggttttatcattcagacgaatgccctgacacgttttatggaagacaacgggcttcaagcagatcaggaacagctggagcgcgccattatgaacggcacgttttcaaaagagcttcgggaggaactgaccgcatcgttttatgaattgagagaatcatacgcctctgtcgccgtacgttcctcctccgcgtccgaagatcttgaaggcgcttctttcgcgggacagtacgaaacctatttaaatatcaaaactgaagaagagtttctcggaaaagtgaaagagtgctgggcttccttcttctcggcgcgggtcagcggttataaagagaaaatgaacaatgacaccgcagaaccgttaatgggcgttgtcgtgcaaggtctgatcaattccgaggtttcaggggtcattttcagccgcaaccccgtcacacatgatgacggagaactgatgatcagcgcgagctacggcctcggagaagcaatcgtctccggcagcgtgacgcccgacacatttatcgtcaataaagacacatttcagattgaaaaagaaatcggcttaaaagaaatgtatatcgtctctaaagacgaaggcgtgacggaaaaagagacgtccgctgacatgagaaaccgcttctgccttgatgacgagagcgtcaaagagcttgccatgctgacgataaagacggaagaactgtacggttatcccgtggatctcgaattcggatttgccgaaaataagctgtatctgcttcaggccagaccgattacaacgatcgcgcaggatcagaaagcggcagacgaagaacgggaatttatcatgacgccccgggatcagaaagatttttggctcaatatggagtccaatatagaaggtcccgtcagcccgttattcgcttcactcattgtgccggctttggaatacggcctcaaagagagcacgaagaccttccctgtgatgggcatcgagattgagcgtgtcaaacttcatcagggccatgttttttccagacagcataagacggacgacaagctgcccgcagaacagttagaagcgcttttccccgtcttggctgaccgcatgtacgatattattcaggaaacctttctgcctttttatcaaaagctggacgaactggcgcatacagaccatacgccggagactgccattgatgcgttccgaaacctgcaagacttctatttaaaaggatacgcagaacatttcaatattgtctttccgcaggttgcgttaaacatgatactggaatctatgtacggacaggttgagaaagaaaacacctcccttctgtatgaaatgctggccggcgtcatgaataagtcattggagaccgacagacagctctggctgctttccggacaagtaaaagacagccctgagctgcggcgcgtctttacggtttctcatgccgatgagctgcatcagacgcttctgcaatcaaatgagggaaaacgctttctcgaacaagtcggcgaatttttacaggaatacggctggagatccgtgaaaagtcatgatctcattgaagaaacttgggcggaaaacccttatttcgctttggccaacattcagaactatgtccgaaacggatacgattttgacagtgagtttcataaaacgatagaaaaacgaaaacagctctacgccgactttatggatagaattgaagatgacggcttccgggagacatttgaccgctattatcagtggacattgtcttcatccgtcatcaaagatgatcaccatttttatattgatgcgatgctggacgccaaagcgcgcctttgccttctgaaaatcggcgagctgcttcaaaaacaaggcgtaatcgatgatcgggaggatatgtggtacttatacagcgatgaagtcgagaaagcgctggcgtcgccggttccgatgcaggaaaaagccgctgaacgaaaacggctcttccagcaatatcaattgcttgaagcccccgcttatctcgggactccgacttcggaacagctgaaaacggctgaacagattaccggctccatcacagaagatgaaaaaaacactgaacatcaaatttacggacttgcagcgtcaagcggaatcgcaagcggaccggtgaaagtcattcgtgacgcaagtgaattttcccgtttttcaacaggagacgtgcttgtctgcaaaatgacgacaccgctttggaccagtctgttccaggatgcaaaggccgtcattacggacacgggcggcatcctgtcacatgcggcgatcatcgcgagagaatacgggctcccggccgttctcggcacacgtgccgcgactgacaggctcaacgacggagatatcgtcacggtagacgggacaaacggcaagattacgattgtcaaacgcgcttcatgctaggtttccctctttattgacgggcagggcgggtgtatacttgtcctgccagtatttacgcgaggtgaaacatgttgagaacgacgaacaagagaattattgacgccgcgatgaatctgatcatccaaaaaggataccgcgcagcgacaacaaaggaaatcgcagaaaaagcaaaagtaagcgaagcaacgattttccgtaattttaaaaacaaacaaggattaatgaaagccatgattgaacagcaggcgccggttccggaaagcatgatcaccaaggcggaaggcgatctgtatgaggatcttcttcatttcgccgcgacccttctgcagcaattggaacaaaaaaaagaagtgttccgcatctgcctgcgcgaaccggaactattcgaagacgtcctgcaggatattgtcgtatatccgcaatccgtgaaaaagcatttaatcgtttactttaaggagctgacaaagaaaaatatgataagccccggcagcgaagaagctaatgcagacgtctttatgacgatgattttcggttattttatacaccggctgcagctggggaaaagagtcattactctctctgaggaaacgatgctgaaacacagcactgagattttcatgaaaggcattaccggccggtcattttccggctccaaggaggatgaaggatgggttcaaagaaagaatgggcgctgatcgtttcgcttttgctgggagccatactcgttcccatcaattctacgatgatcgcagtcgccctttcatccatttcccgctcattcagcgaatcaattgccagcatcacatgggtagtgaccgtgtacttaatcgtgatggcagtgacacagcccattgccggcaaactcggtgatatgtacggtaacaaaaaaatgtatttatggggcgtcggcctttttctcatcgcatcattggggtgcgccctctcgccaagtcttttcttattgattttcttccgggcgcttcaggctgccggcggcgctttgcttacgccaaacagcatcgccatcatccgccatgtcgtgtctgaaaaacggcttccgaaagtattcggctttttcggcctcggcgccgggctgggcgcagctctcggtccgtttatcggctctctattaattgagagcttcagctggcattcgatcttttgggtcaacattccgtttcttgcgatcgcactcgtgacggcattaatgatgtttcctaaatataaagaagaaacgtctgacgctccgcttgatatcatcgggtccgttttgcttgccggaagcattgtatctattattcttctgacgaaaaatgaaagctctttgggctattgggtgtacgcgctgctcattctcgtattggttccgctatttttcaggcgggaactgcgcacgaaacatccgattattgattttgatctatttaaaaacacgacctttacgagcgccaatctgtcggttctgttaagtaatttaatgatgtacgccgtgttattgattatgccgctctttatgaccggccacttcagcatgaacacgtcgcacagcggcatggcgctgtcagtcttttctgttttcatgtccgccagcaactggggcggagctcagctgcatcagaaatggggcgcgcgaagaatgatttttctgtccttcgggctgatggccgcagccaatctcttatttctgcttttggtttattcccattccgttccgtttcttatggcatcgcttattgtaggaggcatcgcgtcaggtgcggggctgactagcatgcaggtatcttctcttgcgacggtagaaccgggcatgtccggcatcgcatccgggattttctccaccttccgttatttcggaagcattatttcttcagcactgatcggtttaatctccgggtttcatattctgtttatcatattgatcggagtttctgtgatcggcttgttcgtatcgcttggaattaagtccggggaaaccgttcagacgaaaaaaagccattcggcataacgaaaaaggttccgtaagcatcagctttccggaaccttttctagttttccttcttcattttctctctcaaagtgtcaccgcaatgccgtttgctctataagaatcttttgatttacaagagaaaaggggaatgtaaatggctgagagttccgatcaagttcggcgctgacatcgtaatccggccgtaaaaagcccggccgccgtcttttattttatttatttcactcactcctatgttcaacttgagcccactatcattactatataaacctataagtattcaagatacatttaattgtacttctctatctcgctgctctgccagcaacaaattcaccatatcactatagctattcaaaccgtctgtctgattatttgccttcagatatacatcatttacatttcttgaaatacttgaaataacaccctcatacttatcccggtactgctcattttgttctatatcatgctgcaccgccttggacagactggacattatatcagacgcctgatctggatccactttctttagctcagatatagaataaacaaatgctagaaaaaaaccactgtaaagtatcattggatcatcctgctgcttacatgccagatatgctataaaatttgcctcatcctcatgcatgaaaccactctgatgtgccaattcatgtgccatagtagcaggcaccaagaaaacgggcacattaacattgatattggattcataagtaaaagggacaaagatgccatttatccctgcatgcgacattagctttgacatcacaactggttttggtgttgagtataaagaatgctccaaaataggatattcctttgataacatttgcatcgagaacactgcgtgttgtgcataataatcaaaaacctctggtacttgagccaaaagatcagtgtccgctaacttttcccttgccaattccatttcaacggcaagcgacttactcaatttgaccagttcctccttgctgtagttctcttctttatattcggtataagacaaaaaagaatatctgtaatagtttattccacccaaaatagtataacaaaaatatatcacgctacagatcgtaactattcctagagcaccacgataaactaccatcctacgtacacctttactcatgataaccttgcgcacataataaacgatataaaatagaaaaagtaacacaaccaacacgacgagccattcactaacagaaaacttgacccaagaaggtacaaatcctactatttttgacaataacggatatacagacctactgtatttttccgcccaatcctgatggttctgcgcgtattttgtcagtatgtaagctataactccaagtgaaatcaacggtaatctcttaagtaaaagcttttttataatgtactccccctatccaacataaccattataatcagttattcttaatatatatcccgctaaagattcatcttctaaaggttttggagttagcaataacctttccaataagccatacctctccttcatttatttttttattatttcaaaataaaacagctaagaaaatataattttcttagctgttttactttctaactgattttgaaatctagtttaggagttcttgaaactattccgaataattatgaaaaatcacattataatgctgtcatttcttcgtgctcgtgttcatcctgcacgaataaaatacctaattcatgatgttcgccttcataggacgcgcgctgatcaaaacggatctcaccgttcaggccgatgatctccatttttacaaatgcgcggttcttttgaagtgcttcataaaaatccgatacatgtttcacggggatgccgtttactttcgtaataatctcaccgatcttcagctcaagatcgtccgcgggtgtattcggaatgatgccgagcaccattaagccctgatcccgcttagagaaataaaacggagccgcgttatcgttcagccgctgtctcaatgataaaaacaggcgtccgagcaccgcaatacaagcggcagctccggcaagcggagtccaccaaagggcagctgccccgaatgcggtcacgataaccccgagaatcatgacgcgtttcgccgttatccttatgctgacttccggaagtgacccctgcacacgctgtccgaagccggcgatataaggaatccagatcaaatggaaagagccgcccggtacggtaaagacaggccaccaagaaaggtgtgactcaagcccgctgcccggcaccaataagaaaagcggaagcagccatgcgcgattcgccaattgtcggccgatgggcaggcctctgctgctgacgacaagcgccggagatgttttcagatgcgctgaacggcaggcagccgctccctccgtgataatcaaaaggcccataaacacggccgccgatgcccaattcacgccgaatgcctgcggaaaccgatccgcaaacggcactgtgtgggtatactgaaggataaacgcaatgaacatgccggcgctgacaatataagctgaggacagccaattcatacggaacgtcagcgaaagcaaagcagtcacagccgcgattatgccgagaagaccgaatggaatcgaaattccaagtccaaaaaataatatggagagaagaatacccggtataagtccttttatgtatgtaaagataagctcgtcatacatatccgcgatctttgtatgaaacgtatggcgttcacgtttgatccgcaaatatccgcatgcgagacttatgatgataaaaaaccagaacatcgggtgcaaaaaaaacagaccgatacttttcagaagttcaattccccattgaacagacactgctttcaccgcctcaagccaaacattttaattctattctaccaaataatcattggcttgaatatctcaaacgtctatctctcttccgtcatccacagcgttacatttgagagagagaaatctttcagatagtggtcaacctccacctcgatcacgccgctgatcagaagcatggaccgcttaatatccgtcagattgattcctaaacgtttatggtttttcattaagtaagtgaaataatgcttcgcacactcttcattgatttcgtgaacgcattcaacatttgtgtaattgaccaggtatctgctgaacagcataagaagacttagtgcttttgttgatgaaaatgtgacgtcttttgttctgtcttttagttgttccactaattcataatattttttttcacgcacaatacttgccctcttcaattgtgaacccccatttttttatccagataagcacgggtgattacagctgccgtgctgaagcgccgcaaacacttctgctttcgatactgaaatgcagctgccaaactaaaactgttctctattagaaccttcttttattgtaagaactaaaactgactgaggcaacttgcaaaagtttcattttgaatacatattaaatcggcataaagtctctcttctctataaatatcgggtaatgtttgtcctttataaatgtttaaatgtgaaaatttttttaatatcttgtcaaaaccgtcataattatatgtcttttggttcactttttatgaatgacaaaagaaacaggagacgcaaaaaacgcctccttttcatttattttacaaataatgattttaacgccatttgcagctgcaaatcatttttttcgtcggatttcttttcattcatcagctgattcattttttccgctgtctttttatcaatgaccgctgttttatcaagcttgtaccggtcttgaaacgccagaacggcttttttcattgttttgctgaaatagccgtccgctctgcccgggtcgaagcctaggcctttcagcaggatttgggcgtgtttgacatccgcgctgttcatatcaggctgaagcggctgtttcagctgaagcggtcccgccgcaaaataatccggctggctcacagcgattgtcggagcaatgccttttttgtgaatccaattgcccttcggtgtcagccatttgtaaagcgtcaatttaatgttgctcccgtctcccataggcacggcctgctgaaccgttcctttaccgaaagaagtgtcaccgacaacgtcataatgtcccgcttcttttaacgcgcccgcaagaatttctgaagcggaggcgcttcctttatctgttataacattgacgggatacggcttcttatgttttaaggttgagaaatattgttttttatcgccgttacgctccgcaatttggatatacggcatgtcttttgtgatgaaatgctttaaaatttgttcgacgctttgaaggtagccgccgggattcccccttacatcaaggacgagaccgtcaatcccttgtttttcaagctttttcagcgccgcggcgaagtcctcggcggtatgctcggaaaatgtcgatatgccgatgtagccgacatgatgaccgcctgattctttgcgggaagcaaatacggtttcaagcgggatttccgctcttttaatccggaatgacagctgtttttcagtacccggacgctgtattttaatagaaaccttcgatcctttttttcctctgattttcagcacggcttcgtttaaatctttcccgttcattgacacgccgtttatactgatgatttcatcattcggcttgaggcccgctttttctgccggagattgcttaaacggtgatacgataatgattttattgtctttcataccgacttcagctccgatcccttcgaaagaagaatcaagagaatcggaaaactgcttagcggtctgcttgtccatataaacggaataagggtcgtttaatgtagacagcattccctgaatcgctccttcaagaagcttttctttatctacattttccacgtattcgttcgagatcagctcatatgctttttcgattttttccattgcccgggttctttctgcgtctgatgaattcggctgtgccgccccggcaatatgggctccgccgcacatcatgcttagggccgctatcactgcgatcattttctgcttcatcgtttacctcctcttagtcctttaacgaaaacctggagatagtatgtgtaaattgcaaagaattcatgtaacggcaacaaaaaaatgaagatgcgagattgtttcatatatatgggtaacgtataatattttgtatgcaattcattaaatatacaggagaatgcgatatgaaaataaaattatcgattttatccgcggcggttctggccacaggcattaccgcctttgtctggccaaaaacagaggccaatgaaaaaacgcagacggacgccttgtatgtttctcccgcaggcagcgaccaaaatgaaggaacgaaagaaaagccgttccgcacattaaagcatgcggctgaaaaggcagaggccgggacaaccgtattgattcgggaagggacgtacgatgaaacgtttgaagtaaagcacagcggcacggccgaaaagccgattacatttcggaactatcagaatgagcatgtctcaatcagcggcaaatctgcgccaaaaagcgattctgaaactccgttaattcaaatccgcaataaacagtacattaccattcacggcgttacgcttgagaatctctccgtatcatcagaagatgcgacggccatggggatctgcgtcaccggatcaagcagtcatatcaacattgacggcaaccatatccggaacattaaaaccacggctgatgaaggaaatgcacacggcatcgcattttacggcacaggtgccatgaaggatgtcagcattacaaataatacggttgaaaaactgacgctcggcgcaagcgaagcggtcgtgctgaacgggaatgtcgacggatttaagattgccggcaataccatccgggacaataacaatatcgggattgacgtgatcggatacgaaggaacgtccaagcaaaacgactatgcgcgaaacggcgtcattgaaaacaatacggtgagccataactcttcttacggaaatcccgcttacggagatgaatattcagcgggcggtatttacgttgacggcgcagaacatgtggacattaagaaaaacaccgtttacaacaatgaccttgggattgaagccacctctgagcataaagggaaatacgcacgagatatccggattacggataacaaggtgtacggcaatgcatacaccggtatttcaatcggaggctatgacacgaaacgcggcggcaccatcaattcggtgatcgctcacaacatcatgtaccgaaatgacacgaaggaccttgacggcggccagctgctcctgcagtacggcacaaaagggaacacgatcgaaaaaaacatcatgacggcaagcgattcacggatttttatcgcaaatgattttacgaaaaacgaagaaaataccgttaatcataacgtctatcacaaagaagagggaaaagacggcatctggaattggaagaacagagaatatgattcattcacagcgtaccgaaaaggaacggcaaacgattcggattccatttatgcggacccgatgtaccgtgacgaatcgtcttatgactttacattaaagcccggatcaccggccctgcccgtcattcagtaacgaaaccattaaaaaaagccagtctgtatcagactggcttttttatttatacacgaaggaatttccggatggaagtcagacttccccatactccgatcaccgcgccgatcagaatgagcacaagtgatacttgaaacacaaacggactgtacggcagaagtgaaacaaatgatccctgaactttcggggccacccaagcgaccatcgactggtacgtactcagcacgagagcgatcggtatgacagaaccgaatacccccagcagcagcccttccaggaagaacggccagcggataaaccagtttgtcgcgccgacaagcttcatgatttcaatctcttttcttctggcgaaaatcgtgattttaatcgtattcgaaattaagaacatcgccgtgaacagaaggccgatgattaacgcaatcccgatgttgcgtgacaccccgacgatcttaaacagacggctgacttcttctttcccgtatgtcactttatacacatgatcaagcttctcaatttttttcgcaactttcggcgtatcatgcggatctgtcgttttgacgataaacgcgttgttcagcgggttttcctgatcttgcattttcatggcctttccgctgtcgccgaagcttttgaccaattgatcaagctctttatctttagatgaaaactctacgctttggattcctgaaatgtcttttatctcattctgcagcgtatcctgcgttttcttatttgacgtcagatcgattaatactttaatttccacttctttttcagcatttttagccatgttgtttaaattcagcataatgactaaaaacacgccgaccaaaatcaatgtaacggtaacggcactgatggatgcaaatgtcatccacgtgtttcttccgagagatttaaaactctcacgcaaatggcgcccgagaattttaatcataagaaccatactcccctcttgactcatcacgcacaataattccgtcttcgatcgcgatgacccgtttcttcatggtgtttactatttctttattgtgtgtcgccatcacgacggtcgttccgcggttattaatctcttccagcgtcttcatcacttcccatgatgttaccggatcaaggttgcccgtcggttcgtcagctatcacgacgtcaggattgttgacgatggatcttgcgatggaaacacgctgctgttctcctccggaaagctggtcgggaaactgccgcgctttatgcttcagctgcacaagatcgagcacttcgagcacgcgttttttaatgactgactgctgctctccgataacctcaagcgcaaacgctacgttttcaaataccgtcaatttaggaaggagtttgaaatcctggaaaacaacacctattttacgccgcacgaaaggaatctctttttctttcacagccgcgagatctttatgattaatcaatatttgcccttttgtcggtttttcttctctgtaaatcattttaataaaagtagatttaccggctccgctcggtcctacgacatatacaaattccccgggatgaatcatgactgacagcccgttaatcgcttttacaccgttcggataggatttatatacttctttcatctctatcatgaaatcacctaatcttttatttatgtcttgcagccatagagttcgcaaacatacagcggtttatggccgattcgtcaggaaacagatgaaaaatctgaaagttccttttcctcagtacacttcattatacgtcaaatttagacatattactattacagtttcttttcattcccagaccgagaaaaaaccttgcccctataacaggcaaggtttttctgttattttttctgtgacagccattttgcgatcttcgcggcttcctcatcatttacaagatggctcggcatattgccgcgtccgtttttaatgatgctttcaattttagcttcatcatacttcccgccgacttcctgtaaattcggacctccgccgccttctaggtctttaccgtgacagccgatacagctttgctgataaagttcttcacccgctgacgcagatgcttttgatccgcctgagctgtcagagctttcttttttcgattcattggatccgccgcatgccgccagcaggacggacatggtcagaaccagcgccagcagcgcccattttgatttcatatgtaagatgcaccccttcgctattataacctcgtttacgcgcgtttgaaaccctcgccgagcacctcgcttgcgtctgcgacaatgacaaaggctgactcatcaatttgtttgacgatttgtttcagttttgtgaattcggtctgaccgacgacacacattaagatcggccggtcatgttccgtatacccgccgactgcggaaatcttcgtcacacccctgtcgatttctttaaacacagctgatctgacggcttcttcatgctgcgtaatgattaaagccattttggagcggttgaacccgacctgcacgacatcaatcgttttgcttgaaataaataccccgagcatcgcatacagtccctgctccactccgaaaacgagcatcgcgctcagcacaattaatccgtccatgatggcaaggcacgttcccagcgacagccccgtgtatttgtgaatgatctgcgccgccagagccgttccccccgtggagcctttgccgagatacacgatgccgattcccgttccgatcccgacgcctccgaaaatcgccgccagcagttcatgggtcgtcgcgggaggcagatctcttgttaaaaagacggcaagcggcagaacgatggaaccgaccagtgtcttcattccgaacttcccgccgagaatgatcactccggcgataaacaaagggatgttaataatccactgcacgtaagccggttcaaaaccaaacgtttctaaaatggtgctgatcccgcttactccccccgctgctatacggttcggcagcaaaaatacgttaaacacgacccccgtaatcgccgcgccgatcatgatatatatgtaatctttgatcagacggagcggcttattgtgattcacatccatgcaaaatcctccgttctccgattttctctcgatagcattttaagtcttcccggcttagaagtaaataacagccaaataccgtattaatttgctaaagcgctgttgtgaaaaatggaaaaagagaacggataaaaaaacacaccttgccaaaggcaggtgtgttcccggattacgacagtttagaacgtaaataggcgtcaatgaagatatcgatatctccgtccataaccgcctgcacgttccccatttccgtattggtgcggtggtctttcaccatggagtacggatggaagacgtacgagcggatttggctgccccagccgatttctttctgttcgccgcggatttcgtcaagctccgcctgctgttcttcaattctgcgctgatacagcttcgctttgagcattttcatcgcccggtcgcggtttttgatttgggagcgttccgtctggcatgtgacgactacatttgtcggcaggtgggtgatccgaacggctgaatcagtcgtattgacgtgctgtccgccggcaccgctcgcccggtacgtatcaactttaatatcttcggtacgaatatcaatgtcgatttcttcattgaattcaggcatgacttcacatgacacgaatgacgtgtgacggcggcctgatgaatcaaatggagaaatccgcacgaggcggtgtacgcctttttccgcttttaaatagccgtatgcattgtggcctttaataagcagtgtgactgacttaattcctgcttcatctcccgggagataatcaagcgtttcaactctgaagccgcgtctttccgcccagcgggtatacattctgagcagcatggaaccccagtcctgggattccgtaccgccggcgcccgggtgaagttctaaaatcgcgttatttttgtcatatggttcactgagcagcagctgaagctcaaattcattcaattccttcgttaatgacttcagctctttttcaagctcttgctgaaggtcctggtcaggttcttcttttaaaagatcatgtgtcatttgcagctcttcgtgagactcgctcagctgatggtaggagttcacgtattccttcagaccgttcgcttcgttgatgacggtttgggccttctgctggtcattccagaattccggttccgccatcttttcatctaattctgcaatgcgggcttcctttgattcgaggtcaaagagaccccctgaagtccgctaaacgagaagccatattttcgagctctgccctgatttctgataattccattccattcacctcattaaaagatccggggcgccataagacgcagacccggtcatgttcgcttcatacagtcgagactattctgtccggccgcagcaatttttatatttttttccgcttccgcaatggcaaggcgcgttgcgtccgatatccacaaccttgcggaccggcgcttttttcgcttgtttggcctcatcgccgtcctgcggctgatgagccgtcgtttggccctgaacaacttcttcgcgttccagattgctttcaatctcggccttcatgacgaatttcgcaacttcgtcctcaatggactcaatcatgtgctcaaacattgcgaagccttccatttgatattcacgcagcggatttgtctgcgcataagcgcgaaggtgaatcccttgacgcagctgatccatcgcatcaatatgatccatccattttgaatcaacggcacgcaatacgatgactttttcaaattcacgcatctgctctgtaccgaaattctcttctttttcattatattttgtcatgatgcggtccatgatcatctcatgcatttcatccggttcttttccgaagatatcgctcttttcaagcgcgccttcatcaagatacgttgaattcaccagctccacgaggccgtcaagattccattcttccggaagctcctctttcggcgtataagcggcaatcgcacgctccagagaagacttgatcatgccttccacaatgtcgcgcaggttttcagagtcaatgacttcaaaacgctgcttgtaaatgacttcgcgctgctgacggagcacgtcgtcatattgaagaagctgtttacgtgaatcgaagttgtttccttcgacacgtttttgagatgattccacggcgcgtgacaccattttgctctgaatcggcgtggagtcatccataccgaaccggtcaagcatcgccatcgtccgttcagctccgaaacggcgcatcaattcatcttccattgaaagataaaattgtgtgatgcccgggtctccctgacgtcctgaacgtccgcggagctgattgtcaatccggcgggattcgtggcgttccgtaccgacgaccgcaagaccgccaagctcttttacgccttcgccgagtttaatgtcggttccgcgtcccgccatgttggtcgcaatcgtgacagcgcctttttgtcccgcttcttcaataatctgagcttcacgctcatggtttttggcattcagtacctggtgcggaatccctttattcttcagaagtttagaaatcaattcagacgtttcaacggcaaccgtaccgacaagaaccggctgtccggtcatgtagcgctgggcgacatcctccgccaccgccttgaatttcccttccattgagcggtagatcaagtccggacggtcgtcacggatgaccggctggttggtcgggatggatacaacctgcatgttataaatattgcggaattcttcctcttccgtttttgcggtaccggtcataccggccagcttttcgtacatacggaaatagttttggaacgtaatcgtcgccaatgtcatgctttcattttgaatctccaggccctctttcgcctcaatcgcctggtgaagaccttcgctgtagcggcgtcctttcatcagacggccggtgaaggaatcaacgatgacgacctggccgtcctcaacaacataatccacgtctttctgcatcgccgcatgggcttttaaagcctggttgatatggtggttcaaggccacgtttttgacgtcaaacaggttgtcgatgccgaacgttttttcagccttcgtcattccttcttccgtcagctgaacgcctttcgttttgacgtcatacgtataatcctgatctttcttgagcgtgcggacaaacgcatttgcctgcacgtacagttttgtggacttctgagcttgtccggaaataatcaatggcgttctcgcttcatcgactaaaattgaatcgacttcatcaataacggcaaaatgaagcgggcgctgcaccatttgttctttatagagcaccatgttgtcacgcaaataatcaaagccgagttcattgttcgttgaatacgtgatatcggctgcgtaagcttcgcgtttttcgtcttttgacattgaattcaggttcaggccgactgtaagcccgagaaacgcaaagatttctcccatttgctgggcatcacggcttgccagatattcgttgaccgttacgacgtgaacgccttttcccgtcaaggcatttaaatacacgggaagcgtagacgtcagcgttttcccttcccctgttttcatttcggaaatgttcccctcatgaagggcgatgccccccatcagctgcactttaaacgggaacatgccggttacgcggcgggaagcttcacgaacgacggcaaacgcttcgacaagaaggtcatccgtcgtttctcctttttcaagccgctctttaaattctgccgttttatttttaagcgcctcgtcagaaagattttcataatctcctcttacggcatcaatgtcatttgctattttttcgtatttgttcagcgcacgtttggtcggatcaaacattttatttaaaatcccaagcatctataacgctcctctatgttcacatgcagattttgcatggaataaatgataattttctgtccatgtatacctctcattatcataacataccttttgctatttccaaagaatttgcagataaagatagagaaaaaccttccgcgcgttcacggaaggctgggtgggtttattcagtcggttcaattaatccgtatttgccgtcatttctgcggtaaacgacatttgtgagattcgtctccgcgttggtgaatacgaagaaattatgtccgagcatattcatttggagaatcgcttcttcattatccatcggttttaaattaaaacgcttttgacggacaatttccgggctgtcatcttcaatttcgtcctgaaccgctacgcccgtatcagcagcgctgccgttctcgaaataatgtttcggaagaccctgctcgcggaattttcggttgacttttgttttatgctttcggatttgacgttccagcttgtttgttgcgagatcaattgcattgtacatatcctcgttatgcacttcagaacgaagcgccagatcagtcatcggaatggtgacttcaactttggattccttatcgttatagaattttaagttgacgttcacatcggcattgacgctctgctcgaaatatcgttccagcttgccgatttttctctccacatgatcctttaacgcaggtgtaacctcaatgttttctcctctgatattgtagttcatcaaagaacgcctccctttatctaaggatatgtaactatttctcttttaccccttctgatccctgctgaaacgttaaaataatgtgtaaattcggtgaacgatgacgaatggtgtcggttttatccggcagcttccggcaggattataagtatatgcaaaggacgcaggcaaaagacctgccgcttgcagcaggtctagtgaagaacatacggtttgatacagtcgtgcgtctgctccatccatagcttataatgcggcagaaagatggtttttaaaaactcctgaaaaggggcggacgggaaatcataatcatttaacatgctgaaatcctgaaagatctcgtcaaatgagcggatcgccgtctccacgcatcggcactcaatgatagacagcagaagcgcatgagaggaatcgagatgaaaaaaagcctgaatcaaatcgttgtaaatccgctcgccctccgtcttaaaaaaatcatcctgcgtgtccaacaggtagcaaagcccctcatcaatcgtaaaaagaagctggtaataggctgacaccaaatggtaatcgttcaaacttctcaaaacactcacctatttgcgtttgtcgtaataacggccgtcacttgtcgcttgctgatacggattgaaatacgtattatggtagattcgttttttcttaagcgtttttatttcatttcggataccatcctgaatccgtttcacttcgccggtaatcagacggtccatcgcggccacctgccgaagcagcgttttttcttcttcggaaaaaggcggctttatgcccgcaagcatctcctcccttttctccgtaaatgccgtaacgctgctgatgagaccgtcgctttccggggcgtccttcagtgcggcgtacatgttcttcgtttcgttatacaaagaaaagacattgctgttcatcaggcaaggccgcccgcgccatggctgtttttccgttcactctgcatggcctgcttccacgtgtcgcgaaattcagtaacgagcttttccgcttcatctaaaaactctccgttattctgcacgttcgcgtcgatcagccggcggcggatgtaatcataaatggatgacatctgctcggaaatctcaatctcccggtttaacgtgatgctgagctcttgaatgatgttttgcgcctttacgatattttcatttttggcttcaaggttgttttgcttcatcgcctgcctggccagcttaatgaatcgcaggcagccgttataaagcataagggtcagctcttccggagcggctgtaaagacggatgtctgctggtaagcagcaaaaggattatttattgccatttttataaaacccccaaggttatgaagttgaagatcctaacattgacgtgagatatgaagattggctgttcaatttctccaatgccgtatccagtgcgctgaactttttataatatctcgtctcgatgtcatccagcttcgttttcatattggaaatatttgtttctatttcatccaggctttttccgatggcaaagctggttgataccgagctttccgtacccgcctgttttgaaatttgaatctgcattttgtttaatgtgtcttttaatctccgggcaatcccctgttcctccgggtttttggttttcgctgtatcagggctgtctgcattaaacagtttagccacgagagcaggattctcggtaattttctgtttcagtttcgcttcgtctttaatgacaagctttccttgatccgtataactatcagacgtctcaattccgaaatcggcaagctgatattttttcccgtcaatcgtaaccgttgagtacagatcaagccgcatctccgccaaaccgttctgcagcgtgctgtcgctccgtaataaaccgcttttggcctttgcttcccactgctcaatctgcttatcggtcattgcttctctttgttcatcggttagcggcttataatcacggtattttgattctgtcaccttctcatttgcgcttttaattaacgtattgtatttatcaacgaaatctttaatgttgttaaaaatgccgtccgtatcagtcgtgctgttaatcgtaaccgttttgttgctgtccgtcacgctgttcagcgtgtatttgatgccgttgatcgtaaagttatttgacgtttttgtcatttcaagcccgttgaacgtaaacttcgcgtttttcccttcggcattggccgtcagttcatttgttgcatcatcaacggcaaaaccgagctgatctttcagaaagcttttggtcgcgtcatcacctgctgaaagggtaaacccttcccccgttttattggaagtgaacgcaatcgtgtccacataatccgagccgttagagattttctcttttaaagccgtcactccgagacccgagctgttcagtttagaaatgacatcgtcaatcgtatcggttgcggcgatcgtgacgtttacctcagtcggcttcgtttcccccggatttgtgacattgaatttcaatgtttggctttgacccgaagtgaaattgatggcccctgaggatttataagtcgtcggcgtagccagctgttgtacagacatgctcgttgaaatattctgttcggcactgacggccaccgcgctgacactggaatccgaacttgttactgtttttttattccagtttgtggacatcagcatattattaaatgtagtagaatacatgtcggcaatctgggtattcatttcccgataagcatcgcgcttccattcaagcgtctgcttttgctggtttaatttattaagcggctgcttttcggcatccatcatttttttcaccagagaatctacatcaagaccggaattaaggcctgtgattcttgtgaccatatgtaccctctccttttcggcgtttagtcgtagacagctctatgacaacagtgagtttccgactgtttatcatatcacagctccataaatgtatgatcttattcttatatcggtcatattaaaaggttttcaataatttaactgcaaaatataatgtttcattttgtcaatagggttctttggcttgctgaaggaggagttagctgaagaaataaaaaaaagaccctggagaaccaggatctttccgtcattaacctttaagcaattgaagaacttgctgaggctgttggttagcttgcgcaagcatagcttgagaagcctgagtaaggatgttgtttttcgtgtactccatcatctcagaagccatgtctacgtcacggatacgtgattcagcagaagtcaggttctcagaagaagtaccaaggttgttgattgtgtgctctaaacggttttgaaccgcaccaagtttagcgcgctcgctagatactgtgtcgatagctgttttgattgttgtaagagctgaagacgcagctttagctgaagaagagatgtcgataccttttgttactttagaatctgcagctaatttttcagatgcaataactttaccgccagcatcgtaataaccagccggtttgtttgtagcatcgtctgcatccgcccaagtagcagtgcttccgtcagttgctgtaagtgtattttgatcaccagatacagtataagtcgtaccaactttcaggctttcagagtccattttattgatagacaggctcattgtttggccttcgttagctccgatttggaacgtcaggttttgcgcagttccgtcaagaagtttcttcgtgttgaactcagtgtcagtagagattcttgttacttcagacgctaattggtccatctctttttgaagctcagaacggtcagaatctgtgtttgtatcgttagctgcttgtgtagcaagctcgctcatacgctgaagaatgctgtgagtttcgttcaatgcaccctcagatgtttggataagagagattccgtcttgagcgtttttagacgccatgtctaaaccgcggatttgagaacgcattttttcagagatcgcaagacccgcagcgtcatcaccagcgcggttgatgcgaagacctgaagataatttttccatgttttttgcagcagagtttgaacctgcattcagctgacggctagtgttaagagccgcgatattgtggttgattctcattttgtatttcctccctgaattgtttttcgcacgtccttgtgcatttgcgcagcgtcatttctgaagaaaatttttcctctcattggctacaatatatatatcggacggccgcttccattgtttatattgaaaataaaaaaatcctcactttttttgtgaggataagttaagtaataaatcagtattaaaagatacggctctgttgttctcttccaggatcgacaagtagatttctttccggtgaatatctacgtgctgaggcgcttcaattcccagcttcacttgttctccttcgatagcgatcacctttatttcaatatccggcccgatctgaatggactcattcacttttcttgagagaactagcatgatcctcctcctatcagatgttttgtttcataggaagcatcatgtaaaatgatttgtttcgccttcatttcctttttattgacgataatcggcgcttttaaattggcggtcgtgttttcaaaaggctcttccagcgttaaaatcgccatcacttcgacgtcctctatatcttcaatatgcaaaagctcaagcgtcacttggtcaatgtcaaattcgtaccctttaaagaaaataaacggactggcgacaataaaggcgatgtgctcctgtttcacagactgcagcgccaaaaacggtgaatcttccgacaaaggaagaacaacaaattgagtctcttcattaaatcccggcaggccgttttcaaatgagataatctgcccttcatctattctgatttctccgtgatattttgttttaattatcatgcttcacaatcctttaccactttcatcttttattctgcgttgccatcatcaaccgaaatcgtcaccttagggtcttgcatcatatcaatctgaactttccccggcgtataattccatacaggtttattgacggctgcttcaattgaaggtttgcgggcttcaatatcaatcgtaagctttgaaggaatgcagtcaatgtcgacgagaaactgcgcaggcagaaagtcgctgaattcgccgaatggatcgggcggactgacatctgctgcctgccgggccatcacattgcccgttttcttttcgatagccgccatttccttcccttccctgactgtttttgcgataaactcgctgcaggcttccgcacctttttgagcggcttcagcgttcagcttttcaaatgatttgagattcaagttctcccacgccctcgtctggtcaatcgtcagtttggccggcgtgctttcaatgttcagctctgccggcggctgctcgatttccaggtcagcgggcggctgttccatctcgatttcttccttttgaaaggttataccgattttagcaggcacactgtcaataatcaatctcggcatctgcacagagatccctcctatttatagtattttagtaaaaaaagcgatctccctgttgtgagtcgctttttttatatattgaagacgatagttatattatttcaggaagtcgatcagtgacggctgaatgatattcgcattcactgacagcgctgctctatgaaccgtctgttgagataaataatcaacaattacatcttccatttctacatcctcattatccgacaatactttttcagcggttgccgcttgtgattccaatcttgtctgaatgagttccaaccggtttgtgcgtgcgccgatattggatttttcagcattcattttgtcagtaaaaccgtcgatatctgacagaatttgattggaatctgcttcggacagcgtgcctttgcttaaagaagcttctaaggagttgagaaattcaaatacattatctccattttgtgcgacgcctccgaaagctgagtttggatcagaattcactttcagcactgctccgtttgagatgttgatgttaacatccgaagcaccggtataattctcatagttgtacgtatatgtgccgtcggcattttcagtgatcggcgggacatctgaattcgttccgttaaacagataacgtccgtttacctgagtattcgcgacagaaacgagctgctttttcagctggccgatttctgtaccgattgctttcaattctgtttcaccgttcgaatcacttttcgcctgaaccatcaagtcccggattttccccataatatccgtttccgagtttacgcttgattccgagttttccagccatgtaaaaccttgcgaaacattccgttggtactggtttacctgcgcaagctgagtacggtactgcattcccttcattgcgacgaccggatcatcagaagctttcgtgatttttttccccgtagacacttgctgctgaagccgatcgagcttgtcataacttgagccgataaatcgaagagaattttttgcgatcatcccttgagttactctcatttacttatctcctatcttcctccggtgcccataccgttaataattttatcgaatatttcatcctgcatcgttatgatccgcgcagccgcattataagcgtgctgaaactgaatcatatttgtcatttcttcatctaaagacactgcactgactgattgtctccgttcatcggctgaaagggtgttgctttcagagttgttcataagattggccgctttttgtgaattaacgcccagctttccgataagggattcataaaagtcattaattgtagtggtttcaccgttaatagtcagcttgctgttctgtacggctgcaagatttgtcgcgtttgtgccgtcacttttttctccgtttaacgacgctgcgatattatcagtagacgcaaggattttgtcactgacttttattttcgctgccgcaccttttgccggcaccgcttcatcaccgctgaaatcaaaaaatgctgcaccctgttcgcctgtataggtcttccctttttcatgaactgcattaaacgcgtcagcaaaggatagcgccatattgtcaagagccgtcagcatttcaggataaagccctttttcttctccgtttgacatatagccgtatgattcaataagacctaaaagtgagccttttccggtaaatgcatccgcattgaccgtactgctgccgactgacacactcgacacgagtccgctgtccttgtcgtagttgattttcatttctgaaactgtttttgtgttaccgtcgagcagcgttccgagagaattgttgttcccgttcagcaattcgacgttaaccgtgccctcagcagtcgccaaggcatgtccgcccgacttattatatgaaacttttatatttgccatagaagataattgatcaatcaatctgtctctttggtcatacaaatcattagggagcataccgctcggctcaactgccgctatttgattgttaaggtcattcagctgattgagaatggaattgacctgatcagctgtgttatccaggttctttttaatatcaccctgaatgttagtcaaagaggtagatatatagttaaaactttcggcaagagatttcccctgctcctgcaaaactgagcgcgctcccgtattttccggattcgtcgccagatcctgaagggcattccaaaatgaactgagcgatccgtttaatccgttattgtcaagctctttcatgacgccttccatttgcgacaatgaattggaacgggctgtatagtaccctaattttgtattttccgttctgtactgatagtctaaaaaactgtctctgacgcgctcaactgaaccggcttttactcctgttccgatttggccggccgtcagatcactgttttttgataccgcgggataagggctcgtcgattgtaatgtgacgcgctgcctcgtatatccttctgtatttgcatttgcaacgttattagaaactgtgctcaatgcagtctgctgcgcactcaatgcacgccttgctgtttcgagccccataaaagtcgatggcattgaaaatcctccgttctaagcttttgaatcgaataatgtcaaacggctgacaggcttgcgcgccgcttgcggctctttataattcatattctctttttcacccggcataatcatatcgaatgccccggagatgaattgtaaagcctgaatcgtgagctgtttgttcatctcattcacttctttcagacggtcaagaagcgcagacagagagtgaaataacccttcaagctcctgtttttcactgcctgaagttctggagatgcatgcagcaattgtattgtcctcaccgcggctgagaaactgagaagttaacctgattcgttcttcctcagtctgcccgattgcctgaatatacttttgctctttagtcaatatgttggagagctcttttgttttacctgctttcagcgcttccgttttctcctcagacagcgtgagcagatgttcatgcagtgcgcaaagtcgcttcagttgatcaataattggctttgcagacattgactttctcctttttattgctttttataaaaattcactatgttttcagcgatgctgtttgaatctattttatatgttccgctctctatatccgctttaagctgagcgattttttcctgacgtgttttagtgaccgcatctgacgcattttgaagctcttttgcatgagaagaaatttccactttgtccttcggctttgcagcctctttttgtacggcttgcttttcgtaatttttttggtatggattaacggattgtgttccgtactgattgattttcataggattcctctcgctttctgttcgcagtctaattcttttatcgactgcgttatcagttagtttagggaatcaggtgtttttggtattataggcatagtatgtgtcttttgtactgtttttttctttgaattcagcggctgttttttggttcatatggtctaattgtgactcaatatctgtctgacaggacttgcaaaatttccccgtcctgatcggatttccgcacctttcgcaaggatatgccaaattcggaagctggctgatctgaatccttttttgtttgataaacttgaggatcagctcttcatccacacctgtttcctcagtgatctgctgcatcgtcgactgtctgttgatctgctttctcaaaaatttatagacggtttcaaatgctttttcttcttctttaatacatgcctggcacacggtctgcaggttcgttttaaaaaataaagcattgcattttggacaattcgccaattcacccatcgtattaactcctattccttctttaatctgccttatatttctatcaattatatcggcagaaaaaaagaatgatttagctcctgattaaagtaaaagaggagaccgatgacgctttacccgctgtcagcaggacttcggcggcttgatgcagtgtggcgcccgtcgtataaatatcgtctattaagatgacgttcataccttcggccgagttttcggctgctgaaaactttttttctgcggacagcctttctgttttgctctttttggattgtttttcattgttcagtcggatgagggggaaaatgacgggcattccgagcagagaggccagcagctcggattgattgaatccgcgttccgccagccgttcgccgctcagcggaatagggatgagagtatgtgtatttgatggatatgccgctttaaagccggcagcaaagtcacgtccaaatgcttgaatgattttcgcatcacccctgaatttaaaccgggctaatgagtccttcatcgcatcattatacaaatataccgaacggttttgccgcagcaaaaagcgcttttccgtttttgattcccgggccgcacaatcagcgcatttttcatttgactcctgaggcctcccgcatatactgcatacggggccttcaattttttcgaatcggctgctgcatatggtgcatacctcttgctcgggcgccagagaaaacagagatctccaagtcaatgaacttgaaattggtgagtcacacaataaacaattcagagatattacgctccttcccgagtttcacagaactcgcttggattaaccgaaacaatcgccgctgattcagccagaatgacaagcagcgccgtatttttctgtttatcaactatctctgcttttgcataagcaactttctttttatctgtaacatatgccggctcagcccggtttaatgaaagtgccagtacatcatttttgcatacccggcatgtacatttcatatgaagcttaggcatatagcggtcgagaagttcctttaatatgatttctttagaattgacaagcatgctgacagctcctcataggaaagtatgagtatactgtatcatgttttctgaaattaactagtcgaacaatttacttttttgtgccaatttgttcatatgttctatatgtttttttgcttttttcattccgactgtaattccgaaatgaaacaggacgacatcaccgctgaaatgtttataatgccttcccgttctgcccgcgatctgtacgagcgcgctctcagtaaagataggtgcttctgcgccgaggacacatgtctgaactttaggcacggtaacccctctttctaaaatcgtagtcgttaccagcagatcaagccggccgtctctgaaccgtttcactttatcctttctgaatgtgtcttccgcatgtacgccttctgcccgtatgtttaatttctgaaaataatccgttgtctttttcaatacgtgtacagacggaacgaataagaaaaccggcagctgtgattgaagtttttggcggacccaatccgttacagagcgcggcagttttcctttctgaagcttcttcttccaattgccgcaccacaaaaaacgcggctccgggaggggtttccgatgatatctggccggtatgcgaacgcttttcagcaaacctgcttcagcattcttttttaatgtgtcagaaggagttgccgttacataaacaagggcgctgtttttcttcctcgctttatcaacagcgaaccttaatgtctcatcggctgaaaaaggaaacgcatctacttcatctattatcatgacatcaaaaatatctcggtagcgcatcagctggtgagcggttgaaatcatcagcggagtcaagcggcctttgtcctcgctgccgccgtacaaagcagaaacgtcgactttctcaaatgcttttttcagtctcggcagcagttcaagtacgacatctgtacgcggagtcgcgacacagacgcgcaaaccttgattcagggcaaactcgataccaggaaacagcatctctgttttccccgatccgcaaaccgcccatactaacagctcttgtctctcttttatcgcatctgtaagcgcggcggcggcctgcttctgtccgtctgtcagtgttccttcccaagaaagctttacaggcctccatctgttttcaggggcttgattccaagaatataatgatgtcagttcatcagcccttcccatcatgacacaggcacggcaataggtaatctgccttttggcagagggcgcccaaaatgccgcaaagcaggcttgatcagactgaccgcatcgttggcagacgtaacggtttttccggcggatgattgacggctcggccgttatatgctctttttctataaaacggttgatgcgctgatctgaaaacggtatctcagatctcaataaatgcctgccgtaaaagaaatcccgcacctctgaaaattctgaagcaccttcggacatctccctgcctcctttctgttcaaagtatgcctgccgggaatttttttgtcgaatcacgaaaatttaataataaaaaaatctccgcccttgaaaacggagattttcacttagtttttaaagcaccagccgattccgatggcgccttcgcccaaatgggttccgatcacggcaccgaaatagctgttatagaattcgacatgaggatatttaccgcttaactcctgtataatatccgccgcttcttcttccctgtttgcatggatgacagcggcccgcatcgggattcctttacttgcatcctccccaaacagttcaaaaattctcgaaatcgcttttttgcgtgtccgaatcttttcaaaaggaacaattatcttattgtcaaaatgaagaataggctttacctttaacagaccgccgataaaagcctgagcactgcttagacgcccgccccgctggaggtgtgataaatcatccaccataaaatacgcacggactgtttttttcatttcttccagctctttaataatctcttccggtgagtctacaccgtctttaatgagctgtgctgcctttaatgcataaaaaccttgcgccaaacagctgatctctgaatcaaagggataaactttaatatgatcaaccatagtgtttgccgaggcggcgctgttataagttccgctgattccgctggacaaatgtatgcttatgactgcgtcatatgttttgcccagttcttcgtacaatgcgattaattcaccgaaagaaggctgggacgtagtcggcagctcatcatgattttttacttctttataaaaacttctccagtcgagttctgtttcttcgcggaatgttttttcaccgaaaaccacttgaagaggaatcatatgaatatgatgttcttctctcatctctttcggaatatatgctgtactgtctgttacaactgcaatcttcatcactttacctgccttattaagtacttaataagtattttaatagatatgaagctgtaaaaaaagacttgcctattatggcaagtcttctcatacatgactaacgcatctctacccagccgtttttaatggctacgacaacggcttgtgtccggtcattaacgttcattttctgcaaaatattactcacgtggtttttcactgttttctcactgataaacaatgattcaccgattccgcggttgctttttccgtctgcaagcatttgcagcacttcacattcccgtctcgttaatatatgtaatggtctccggatttccggataaacctcatgctgaggatgagcagaaactccgcttgtcgcaagacggcggaattcgttgacaagattgtgggttactttcgggtgaaggtaagaaccgccctcggctaccactttcactgcttcgattaaagtatctgcgtccatctctttcaggagatagcctcttgcacctgtttttaaagcatgagtcacatagttttcatcatcatggatggagaggataatcaccttagattcagggtacagctcaacaagctgtttagtagcctctactccatttacattcggcatattgatgtccattatgacaacatcgggatgataatgctcgacgattcgagccgcctcatctccatcgtcaccttctgctaccacttcaaaggtaggttcaaaatccaatattctttttacaccctcacggaatagttgatggtcgtcgataataacaatatttactttagtcacacgctacgcctccttatcctattgttctatatacgccgctgttcggtcaatatgtcttttggctctatttaacaaattatagaccgagagataacggaaccttaatcatgataaatgtcccaagacctattttagagtctatcgttatcgttccttcaagcagatctactctttctttcattcccagcaagccgaatgacttgtttttcttttgtttagcatccttaatatcaaagccttttccgttgtccttaatgataagaacgacaaaatcagcggttacttccacttttactgttatttcctctgattctgaatgtttgagtgcatttgtgacggcttcctgagcgagacggaaaagcgccacttcaaattgcggggcaagccttttgttctccgtgtctccgatacactgaaaatgtattttcacctttccgttgtattcttcagttgtataaagatattttctcagtgtcggaatcagcccgagatcgtccaatgccatcggtcttaaatcatatataatccgtctgacttcgtaaagggcattccgcacattctgccgaagatttctgatttcctgaaatccgtcctccgtgccgcggtcgcggaagatccgttcaattaattccgatctcatcatgacatttgccagcatctgcgcgggaccgtcatgaatttctctggaaactctttttctttcttcctcttgggcttcaatgattcttaagccgaaatcttgtttagcctgcgcatcggcaagaagaagccctacttggcgaaggtcttgattcaggtaattcagaacgacggttatttggctgaccaatgattctgaccgttcaatgatttcctgaagccccaaaagccggcgttctaaatcatctctgcgctcccgcagctgcttttcacgctgctggatcatcgtcagttccacttgaagtttgtgcgccttttcataggcgttgcgaatttcttcttcgctgaacttatggaaatttctgctcacttcagacaagcggtttcgtgcgtgccgcgtatgaacttcaagtttgtcgcccagctcaatgacttcgtacacctgctgtttgatctgtttgagttcttcaaccagctgctcatattgctggcgcgactgctctccgatttgaaaaacctcgtccttgctcccgtccacggttttcagcattttcataagtatagaatccaaaactttggagtccatcttcgatttattcatctgtctccctccgtaacggtgttgttatgtatttttattataaatgtaattgaactgcaatttatgtcgaattataatgaaagaatgcgtatattctagaaaaaaacatttttatatagtatcttactctttcatgataccaaaatatgcgcaaaaattctaaagtctgttcgaatttgtagaaacaagtcttttaatgcttgtcaggagggtccagcatcatgctgcacagctatttaactgttaaagaaacgggtgaacatgagattgtgattgaaaaatcacgttttatctgtcacctgagccgtgctgcttctgaagaggaagcgcaggaatttatacaaaagataaaaaaacagcactggaatgcgactcataactgctcagcttatctgatcggcgaaaccgaccatatacaaaaggccaatgatgacggagaaccaagcggcacagccggcgtccccatgctggaagtgctgaaaaaacgcggtctgaaagatacctgcgcggtggttacccggtatttcggcggaataaagctcggtgcaggcggattgattcgtgcatatgggaagtcagtgtctgaaggcttaaatcatataggagttacggagcggaagctgatgcggattatgcatacatcagcggattatacgtggctcggcaagatagagaacgaactgagagaatcagtttttttactgaaagatatccattatgcggatcatgtcgaatttgaaacgtacgttgaagaaaaagacaaagaagcgtttctaaaatggatgacagaactgacgaacggcaagagtaagaatacagagggagaactgacgtatttagaaacagacgtcagccctaaaggagactaatgtaatggctgaacgtgtaagagtgcgtgttcgaaagaaaaagaaaagcaaacgaaagatcatattcaaacggattttgctgctgcttaccctcgttttgttagttgctgccggatttggcggatacaaagtatacaaaacgatcaatgcggcagataatgcatatgatgccctttcccgcggagacaaatcaaaattgcgggataaagtcatcaatatgaagaaaaaaccgttctccattttgtttatggggatcgaaaattatgccaccagcggaaaaggcggacgatcagattctcttattgtcgttacccttgatccgagaaataaaacaatgaaaatgctgagtattccgcgtgatacgcgggtgacgcttgccggcgacacaaccggtaacaaaacaaaaatcaatgcggcttttgctaagggcggcgcggatgaaaccgtctcaaccgtcgaagacttattaggcataccgattgataagtatgtcactgtcgacttcaatggctttaaggatgttattgatgaagtaggcggggtcgatgtaaaagtgccgtttgacttcgacgagatgagtgacgtcagtaaaaagaaacggatctatttcaagaaaggaaacatgcatttgaacggtgagcaggctttggcttacgcgcggatgagaaagcaggataagcgcggagacttcggccggaatgaccgccaaaagcaaattttaaacgcactgatcgaccaaatgtccagagctggaaatattgctaaaatcgataaaatcgctgaaacagcgagcaataatgtccaaacgaatatccgaatcactgaaggactcgctcttcagcagatttacagcggctttaccagcaaaaagattgatacactgaccataacaggatcagatttatatttaggcggaaccgcaactacgcgcggaacatattatttccagccggatccaaccaatctcgagaaagtacggcaggaattgcagaagcacctggattacccgtccggaagcagcacggcatccgatcccgcttctgacagcaccggaacggacagtacgactgattcaacttccgacagcacgggaacaggcggtacggctgattcgacttccgggagcacaggaacaagcggcacaaccgattcaaccaacggtactgcaggtgcaaacggtacggacagcacacagtccggcggcacaacaggctattaagagtaaacccgatcctttgagcaggatcgggtttttctatataataagagaatagcaaaaaaacagaccattcgcatgatctgctctttttaatttttctttaccaatcttttgtaaaacttggtaaatggtttaaattgttcatttactaaccctgtgacctctgctatgatttgcataaatacaatcaatacaaaaataataaacagcgaaagccaaatggtcgcgcttttcagcaggatggcactgacgctgaaaataaagccgattaaataaatgataatgacagccgtgcggtgtgacagcccgaaggccatcagccggtggtgtatatgtgacttatcaggcgctgagatcggctgtttgtttaaaatccgcctgatgacggcgaatgtcgtatcaaaaatcggcacgcccaaaatgatgatcggaatgatgatactgaataaagtaacacttttataaagacctaataatgagagtactgagatgacgtatccgagaaagagcgatccggtatctcccataaatatctttgccgggtgaaaattataaaataaaaatccgagtgtgcttcctatcacgacaagtgaaagtgacagaataaggattttccctccggacaacgccataacggcgatagtggagagtccgatgaccgacaggcctgcagcgagtccgtccaaaccgtcaatcaggttcatcgcattcgtaataccgacgatccataacactgtcagcgggtaagcgacccatcccaattctaaacgttccgttaaaaacggtacggagaaaaagtccattttcagtcccgtgctcacaatcataatggccacggccagctggacgaaaaactttacctttgcgcttaattggtatttatcatcaaggattcctaaaataacaataataaacgcacccaccgtaatggcggtcattttcgtttcattatatatgccggccgcgagcacacccgccgctacgccgataaagatggccaagccgcccatacggggcattattttatcatgtacttttcggttgctgggctggtcaactgcacctattttgatcgcaattttttttacgataggagttaggattaaaaccgttagcagagagacaaaaaacgcaacaactatgcgaaacatgcgttcgtcaagcataaagaagtctcctttggaattatatgaagtcttttctgatattgaaccgttccttccattataattcttactagttattataacaagcatcatcaaaaagaaacacgcaaatcaaaaaatgcgctttcccttttaatgggattgcgcattttccaatatacccgtgcattcaagcattcggccgaataaaacattccaatcccgtccccgggccaattcacggcgcaaagcctcgtatgatccgctgcggtccgctgccagaagcgcttcgcaggccgcgatgaaatctgcggggtcgctcccttcaacgtattcataaacgtaaggccttttgatttttgacgtagaagaaaggttgcagccgacaaccggtttcccggcggctaaaaattcaaaaagcttaagcggaaataccgcgtcattataaggtgaatttttatacggcatgatgccgatgtcgacaagctgcatataggacggcacttcattcggcgcggcaggtcccgtccagatgacattcgggcgttccagaagcgactcgaaatccggatcgtcctgagccgtgttcgggcccaccaataaaatcgtccagtcaggccgtaaatctgccgtttccgccataagcgcaaaatcgagcttcggtttgattccgccgataaaaccgagaaccgttccgtttcttccccgtaaaatgtcttcatccggctgtttattttcccgtgaaaacaggtcatattccactccgttttcaatggtgaacactttctggtgcgggttctccagcttttttccgacctcccggtgcagacagtcagatgtgcaggtgatggaatcggcacgctgaatgattctcatttccgcctgtttaatgatgtttcttcttacatttgacagcacaccggcccggccgctgatcggagcggcccacagatcactgcaatcgtaaatcacttcatcccaaggaaacagatctgccagaagcggaaaaccggggaaggtgtaccataagcagcagcgggccccttctccttcttccttcagcatgtgcaacaatggtgaaagtttatgcctgtaacacatgtctgtatacctgccgaaacggaatgctttttgctgcatgagatcctttacagtgaactgccggattccctcggcgatcccggccatctgatcatcattggctcgcggggacgggcatacccaaatgacgcttttcgtttctttttgccgggcaagaaattcagccagccgatgccgtctgtatctcagccggtcatgcccccattccgccgctccgacgattacgtgaataatcggttccaccttcatcacccagctcctctgacgcctacagtcttttcaagaccgcgtttttcgcatattgcataaaacaccacgaagccttgataaaatgcaggcgctcaatttctctataaacaaaccacgttttttttgcggctttccacttgttgcttgaaatcgaattctgcacaagcctgtattctgaaaggcactcattcaggccgtaagccgtaaatccccttttcagcagggaaagccatgtcgctaaatcctgccgcgttctgatatcaggcatttgaatctgccccgtctgctctctgtcaatcatgaccgttaaacatccgataatcgtgttttttaaagcttcatcatatgacaggctttcaggggcttgaatcgttttgtccgtcggcgttccgtcctgctccatgacgctgtagcccgtaaatgaaaaagcgcaggaccgctctgccataaacgcaagctgtttttgaagcttttcctttttccatctgtcatcactgtccagaaatgcgacataacggcccttggcatgtttaagggctgtatttctggcagccgcggctcccccgtttttatctaaataaacgacgcggatccgctcatctttttgttcatattgccgtaaaatatctctcgttccgtccgttgaacaatcatccgcgataatcatttcccaatgcgggtggctttgatgtaaaacggactgaatcgtgtcttcgatatattcacttgcgttataagacggtgtaatgacagatacgaaaggtttccagtttgtcatggtcacatctccatcgcagatttttacaaggactctctaaaaaactcaggaatgacaatgaacataaaggcaactgcaatgccgattaaaacgcccagaaccgctttctttttcggcggcatgccttgacccgccgtttcattcatcggctctgaattgatgacgccggccgctttcaggttcagctgcgtatttttcaattcgtataaaaatcgttccttatccactttggcgtccgcgctgacggtttctccttcaagcgcagcaatactctgccgcactacttttgcccgtttttcaaacaggtcctgatcattcttcagaaaagttgttatgacggcttgaaacaccgattcggtttcctgtttgttttggccgctgtagctgaccgtgatcaatgaatctgattgtgtttcgacagtcagtttacttttcacggccgctctttcttcgtctgttttatcaggcagagcctgctttaaaaaggcatcgctcgtcaaaaggagcgggatttcttttgtattgttataaagcggatgatcataatttcccgcggcgatcgcggcttctgatgtaaaactgctgtttccgctgatttttgacggcaatacatatcccgccgcccctaacacaacgggcagcgcaatgatccaaatgatattctttttgatacgccgggttattcttgtcaacatatccttcatctcgcatctccctgtttttcatagtacgccgtgacggcaggctccttttgtaaacgcctcaatatattgaccgccgcgatcacgagcgagagaaatacccagtggaaaaataaatttgatacggagcttgggctgatgctgcttaccaaaaaaccggccatcgccgtgataagtccttctgtgatcagtcttgactgattttccgattttctttcatgacatttataaagtgtccaaaaaaggaacaaatagactgtcaggtaaccgagcatcgtaagtacgccgaagttcgccataatctcgacgagccagttgtgcacctcaactacgccgcccgtatcataaacgggctccgcttttaaatagtaagagacgtttccggcacccactccgaacccccaggaatcaatcacatagtgaaaggcgttctttaaaagattcgccctcgcgaggttggaaggaagcggctgctgtcccggcatcgcctgcggagctgaaaacagattcaagacggcattggtgatacggcccgcaaataaaaccgcaaacagcgcagcacccgctcccgcagcgtacagcgcgaattttttcaacagagaaggcagcaggatgaagacgtatacagccgcccccgcgcatatgcccagcagactcgcgcgcgaaccggtcaaaatgattaaatacaaagcgcagatcgctaagagcaggctgacggccttcacatagccgtttttcatatttttcaccgccgccgcatacagaaagaaactgatgcacaaaaacgtcgcgaaatcattttgattaaagaaaacggacgtcggataatgctgtttgtactgcgggccgttataaagcgtggagcttggcagatggttgtgtgtaaaatggttgtaaaagccgatcgccatcacaaaaatggtcatcacaagccatatgccgtaaaaaaccatcagctgatcaaagcgctgaatgaacatgacaataagataaatcaaaaacatgcccattcccattaaagctaaatatttaatcccgtacgtcacggattttgcccacaataacgataggagaccgtatgtaaaccataaggcgaaaaacatcagaacctcttttacattcacccgattccatctgtcaatatgatgacggtttgtcaggatgccggcgatgtgtagggcgcccgctccgattaataacagccggtatataaataagctgaaaaatccgagatgaaccgcaaagaaggcctggtttaaaaatgtacacgcgatcagtatataaatgagccccataaacatctgaccgtttgttgtaaaggcggatagcaaagcaagtccggcaatgccgatcatggcggcaagcagcagcacggtgatttttccgaggccggcatccgccctgaccgcctccagcatgatgaatcctcctgtaatgacagcggcaagcagcacaagaacatgtgctgctgaacgtttgatactcacatggcaaacccctttccaaaaccggcagccgagccgggctgccgagagcctgaagacaaatctttttctatcttgccagttcttttatttgccgatcggcatgaaccgccggacgaccgacggaatgataagtgaatcctgaaaccctcatatactccaacggaaacatatttctgccgtcaatgatgaccggctgtttgagcagctgcttcactctctgaagatccatctccttgacttccggccaatctgttgtaatcaggcatgcgtccgcgtttttgatggcactgtacatctctgcgtgatattcaatgccgccttctcctaatatcgctgccgcttcgggaatcgcgatcggatcatacgctttcacgtgagcgccctgctctttaagacttgtgatgatatcaagagccggggcggagcggacgtcatttgtatgcggtttaaaggccagccccagtacggccacggttttcccttttaagggaccgatggcgcggttcaatttttccgtaatacggaccctttgcttctgattggtttcaatgacggcttccatcatttcaaacggatagccggcggcgtttgcgatatgcaataaagccgttgtatccttcggaaagcaggatccgccgaatccgatgcctgcctgcagaaatttattcccgatccggctgtcaagaccgacgccttctgacacgtgagaaatgtccgccccgacacgttcgcaaatattggcgatatcgttaataaaagatattttggcggctaaaaaagcatttgcggcatacttaatcatttccgcgctttcaagattggtctttacgatcttcgtacggaacggcttatgaagctcttcaatgaccgaagcggcatgttcgcttgtggcgccgataaccgcccgctccatctgcatcgtatcccgcaccgccgaaccttcgcggaggaattcaggatttgacgcgacatcaaacggatatgttccctttgacgcttcgctgacgatttggtaaacgagctttcccgtcccgaccggaacagtgcttttggtgacaatgattttgtatccgttcagctgttctccgattgtttgcgccgctgccttaatgtaggtcagatcggcttcacccgtctttgacatcggcgtaccgacggcgatatagacgatatcagcggctttcacagcaggctcaatatcggccgtaaaggttaaccgcccggcactgacatttttttcggctaattcctcaagccccggttcatatatcgggatgactccgttttgcaagcttctgattttcgcttcattgatgtcacagcaagtcacatgatggccgatttccgcaaaacaagttccagatacaagacctacataccctgttcctaatacagcgatttttttcacagcttcatccctctttcgaaaggttctcctcttgcccggaccggttcatgacggaccggtatttctctttcagcgctttcgcgttttggcttgcgtcaaaatacgtgcggacggtttgataaagttcctcggctgtttgcggcgtccaagcctctccttcgtcatattgcagaatggattctgccagcgtgccaggtgaacccggcttgatcagcaaacctctatatttcccaaataaagaagccaatcctccgacatcggtacagatcaccggcaccttcagagcgagcgcctcaatgaccacagtcggcatgccttcgctgtaggacggcagcgccattacatccgaggccagcagatagtcctgtaccttgtcgttcggcacttgccccgtgacgatatgagcggcttcacgcaatgaagatgcggctggaccgtcaccgacaaagacagcttcatatctttcatccaatgactgaacggcttttgataagtcgaaaacacctttctctttgacaagcctgccgatgaacacgatcagttttttatccggaggaaggccgagccgttttctgacggcttctttcgtctcgttcctttttcggaaggcgtcaagcgtgatgccgatcggaagcacgctgcactccgcttcgatgagctttttcatttgttcccgcagactgccgctcacagcgtaaatatcggctgcttcccgcaccgcaaatgtaaacgcgcgatgagcgcttttgctgtaatgcggatagacattgacatcactgccatgcaaggtcagcacatacgggatgcctaaagcctttgacacaatggcggccgctccgcctgacggcatggcgaaatgcgcgtgaatcagatcgggcttcaggccatgatttttaatttcggaaagaaccgatgacgccattcttttatgcggctgcgcccatttcagctgcccgggaaccgcctgataaaacggccggtggacggacacgcctttccgccattcatgcgccggccttatatccttttgccgatacgtctttttcagcacccggaatggcgcggcgagtttcggccggggacaaatgacagtcatctccgcgccaagctttctcagttcttgggcctgcgtctcatgaaaaacgccttctcccggcttctcactgctcggatatacacttgtcatccacaataccttcatagcaaacgtccttttcttaatttacttttcatatgcggataagcttttcctaacaggaacaaataacacaatgctccgcaggatacggagatcgccagccgcagcttgacatcaaggctgatccgctccgtcccgaagctggctgtaaaggcgatgacacccattgccgccgtaagcagaaacggtttggccacggctttgaagtaagccgacagccgcagcttaatgacatatgccagcagccagcgcccgatcaggaaattcaggatgctgatgaaagcgtacgtccaggctaccgtcaagagatttccggacagcacggcggcgtacaaagatgcaccatacagcagcatcaccccggcgtcccaataaaatgccagatcggcccgcccttttgccagcagcacagatccgttcggattcatcagaacccttaaaatcccgacgatggcgagaacgtttaaaaccgggacagccgccagccatttttctccgaaaaccgaagccacgaatgcatccgatactgaaaccaaaccgagcaaaagcggaaaggatatcagcgcgagtattttggtcatattgagaaaaccttctctgatcacgctattttcatgcttgtttttcgcaaagacgggaaacgcgactctcgtaatgatcggattgatttttaataccggaagcgtgacaatctggtaggccagattgtaaatgccgagcgcctcggcgccgataaaactgccgatcagaatcatatcaatattcgccccgagccggttcacaagccgggaagacagctgaaaggctccgaaagaaaagaagcctttcattcccttcagatcaaaaacgaacgccggtctccatgtttttctgcaggacacccagtacagaataccttttgacgattgcagcagcacctgggaaatcacataggcgagaatcgggtccgtataaaaaaccgcagccgccaagtaaacgaaggacagcacatttgaaaagatttcaatcttgcttagcgtgttaaatgccagcgctttttgcagcatatattgatattgctgaccgatcggcgcgattaaaaacatgacggccagcacgcggattaaatagacaagctcctcccgccgataaaaatcggcaatgagcggactgctgaagaacagcagcgcaaacagcgcaagccccgttatgatattcagccagtacaaggaagacatctgtttatcagtcacatgatctttttgaatgagcgcggcgccaaaacccatatcaagcgcaatttgggcaaacaccactaccgttgtgatcatgccgacaaggccgaattcagccagtgacatgacccgcccgagcagggcgaattggacgatttgaatgaccgtaatacacgctgtcgaaatacttgtccatttggcgccgctcaaaatttgatttgtaatactaggcatcgttttccctacttttttgtctgctgaccagaatttttatcgcgccccgtcaccggtccagatcactttgcacgttttgagcataatcttcagttccaatgaaaaggtcaggttgcggatataatataagtcaaacatcagtttttccctcggtgtcatgtcatatcccccgttgacctgcgcccagccgcttaatcccggcttaacggccagccgctccgtaaaccccggaatctcagcctgaaactgttccgtaaacacgggacgctcgggacgcgggccgatcaggctcatttctccccgaaggacatttaccagctgcggcagctcatcaatacgggtccttctgataaaagcgccgacctttgtcacgcggggatcctttttcagcgcccagaccgcccccgatttttcagcatctattttcatagagcggagcttatacaaataaaacggcttcccgtctttgcctacccgctcctgcttgtaaaaagccgggccgggcgactccaaacgaatcagtatggagaacaggcccatcaccgggagcgccgccaaaagccccgcaagcgcaaacacaatgtccatgaatcgcttaaaagccaaataacgggccgttctttccgtaacggcagcggaagtcccctgccgcactgcatagttattatttacattcatgcttttctctgctcccactgacacacacctcacgatttgttgggatgtttgatgacctatgccgtgagtttagcagatggatgttaattggaagtaaagaaaacgttaatgtttattagaatgtttcgattattgtttttttattgtaaatctattcatatccatatttgagacaaagcataatgaaaaaataaaaaaacagaccggtatgaaccggtctgtttccatgaaaaaaattatctgaaataggaggaaacgccttgggtgatccccgccgcgagtctgtcctttttcgttgattgttttagaatattggcatcaatcgggcttgtgacaaaaccggtttctaacaagacactcggcattttagaatacttaatgacgtaaaatccggcagttttcacactgcggtcacgcgtgccgagagcagaaaccattctcggctgaatattttgggcaagcctcagactgtttgccgattggtaggttttatcataatacgtctccgtaccgtttgcactgctgttatcattcgcatttgcatggacgctgatgaaaatatcggcgttcgccttcgcccctttgttcactctctcctcaagcgaatcaaaggtgtcgccctttcttgacattacagtaagcgcgcccgcgccgtataattgattgttaagacgcgtagcgatatcaaggtttacatttttctcaagcaagccgtttccggttgcacctgaatcctgatagccgtgtcccggatcaataaagaccgttttgccgacaacgggatttttaagctgcgacgcggcattgttgcttaaagatgaagcacttcctatgacggtgaagctggtgatgtttttacttccgatatacgtccggacgtcttttgacagactgtctccattcgtcagcaggtgaactcttccctgtttggcgctcagcacgcctccgacgatggtatccgcctctttaaagccattggtaacaaacgtatagcctgtgcttaagcctgtcttttttgcaagattcacagacaggttatagcggtttttgccgctgattctcgaagggttcggcagcttattataaagtgagctgctgatgctgcttgtcccgccgatgacaatcgtgtttttaatccctaagcttttgatcgcattggacgcagaaccatttaacgttgaatcattagtgaataaaatcggatattttttagcggacgcataagaaatcgcagccattccatccgcatcaacaaacccgttgaccacaagggctgtagaagatcttgtcatttcacccgccacttttgcggctgtggcatatctcgtgctccctgataaccgtttgacactgatgcctaatttagcaatttgatttgcggtatttttcgaaacggcaggtgtgccgcctacgataatcacatttttcgtttttaaatcaattaatcccttttttgtgccggcagacagctgatctttatttgtaaacagcagcggcgcatttttttgatatgcaagcggcgcagcggcaattgcatcggcatatgaagttccgccggtgataattaccgttttcgcttcaccccatgattgttttgccgccagtacagccgtatcataccgggtgcttccgccgatccttttaaccgtgttgtcagccaaagcggaagggacaaatagaatgaccccgagaataaagacggggagacattttatgatgaatttcaatccgatctcctccacagaagtttagtagtttgtaagtgctgtattaggataatagaacgcaagaatagaagtatacggctctccggcctccgctctttcttttgctccgtattgactcattcctacgccgtgaccgtatccctttcctgatatcgtgatttgcgaagaattaccggacgcactggcgtatgtgcttttaaaagatgaagctccgatcatcgtcctgagttcagacgctttcacctcaacagatgcagtcttgttcatgacatagcccttcgacttgtcattcacatggtacgtgaccttcaccgcggcgtcttccgcgcgctggccttttgtttttccggtgagcgagagatcagagatacttgcaatttttatggaacttgcattggtttctttatttttcatcagccaattttttattccgttgagctgcgcagcatttgcttcgtttgttttagaccaccaggatgcgggatttttcatatccagacccgctggcagctgctgcttctgcaatgttaaagaccagctgatttccggatcttttgtgtcctttttggctactaaatacggcactttcgatccccacacttcatcgccggcttccatgtaaccgccattgcttgatgagtaagtggcatctatcaatctgccggaataagtgagcactttcccttttgttccgttaacggctgcggtggcgtttggataccagctgtatcccccgtaaacctgaaaggccgttgtatccgcgactgtttgtcccatcttgccgatagagtaggtgcgggcggcaacagcctgggctttcagcgcttctgtcggccagcttcccggcatttcattcggcaggacacctttcagataatcctcaaaaggaatgttttcattaacaggccttacatatttgccggattcagcagtgaaactcatattccccagatatggcttcccgtcaatgctgattgtgtttgctgttgaatatttttcaggaaccgccttgaaagacgtttttccgctgttaatgcctgcaacgcctaatttgccgccggacgtttcaatacggtacgtctttccgtttacgagataaaactcttttgcgtaagcagccttaactgaatcggcaattgaattcgcgctgcctattaatgtataagaataggtgcctttcgttttaaaaaggccggcctcgtcggcgggtgtttcgctttttttgatgtatacaagcggcatgtgatttgcggcggcaatatttgatccgactacgatgtccgctaatttagtcccgttggcagccaccgttttgcttgcatccatgccaagcgaagtgactgcgtttgctgatatttgatatctgtttgatccggtaattcgtttggtgaccgaggccttctttttaatttgattctccacatctttgctgacgcttgaagtgcctcccatgatgatcacttttttaggcagattgtagctcggaagggagtcttttttcgtcagaagaatcggatagccgttttgcgcggcatatggcgcgattgccagcgcatccgtatatacatcccccgttactacgaccgcctggtcatagctgcccatttcggccgcaatatttttggacagatcatatctgttttttccgctgatccgtttcgtacggccgtatttcttcaatgtcttttccgcggctgacgaaatacttttcgtcccgccgatgattaaaatattatccggattgaatttcttgatttgcgcttctgtgctgctgctcagttttttcgcttcagtcagcagaacaggcgctttcagtttattcgctaaaggaatgacggaaagcgtgtccgcaaaataagcgtccgtattcacgacgactacgttggacgggtttttccaatacttagatgtcgcggcgttagccgtatcatatttggacgcgcctcccaatctgacaacggaggacacatcgcttcccgtcagtttataagttcctgaaggttcgatattcagagtcgatttattaccaatataattcgtcagttttactgagatatcagaactggccgcaaaagtgctttccggtaataaagccaggctgaatatcacagaaaaacagacagcccatattgttttcttcaatttttatcccgccttttgctgatcatggtgtattattttgctttctcgatttccttgatctctttttggcctttatcatttgtgaaataagtaatgctgactttgtcattttcgctgaatttattcagaacatcagagaagtcatcagaaaattcaaagctgacgggctgatcatccacttttacttcaattgtgtgcgtatccgccataccgacataatatgccgtttctttttgagcctggttctccgaagaaccgcttcccttctttgattgttccgccgttccgcacgctgccaatacaacagaaaaaagcagtattaagaacgaagctgcaatagtttttttcatttttttcacctcatctttatgtatcgtcttatactaacttttttttaaggtaattttaaggtctttttgtaacctttttttaagaatttcgtctattacatggttataagtaaaaatatgactgggtttataaagattagtaaattgcatcatgaaagttaatagaaaaggtgatgacaaatgagagctgaacgaaaaagaaagaagaaaaaggttcttctgacaatcgtaacaatcatcgggctgttagttttatcatcaggaggctacgtctactacttgtggcacaaagcggcttcaacggtggcaagcattcaggaagacttaaaaaaatcggacaaacgtgacacggatatagatctcggaaagaaggatccgatttctgttttaatcatgggagtcgatgagcggaaaaatgacaaagggcgcgcggacacgatgatttatatgaccgtcaatcctaaaacgaatacaacggaaatggtcagcatcccgcgcgatacgtatacgaaaatctccggcaaaggtacgatggataaaatcaaccactcctatgccttcggcggaacccaaatggccgcggataccgtcgaggacctgctcgacgtgccggtagattattttgtgaaagtaaacatggagagcttcaaagataccgtggatacactcggcgggattacggtgaacagcacgttcgccttcaactacgacgggcattctttcggaacggggaacatcagcctgaacggcgaagaagcacttgcctacacccgcatgagaaaagaagacccccggggggatttcggcagacagcagcggcagcgccaagtgattgaagggattatttctaagggggcaaacatctcgtctgtcacgaaattcggagatatgtttaaggtcattgaaaacaatatgaaaacaaacatgtcattcgatgatatgtggacggttatgactgactataaaaatgcccgcagcaaagtcactcagcatgaactgaagggaacgggaacgagaatcaacaatatctattattacaaattagatgaagcaagcctcgcttcagtcaaaaaagaattaaaagaaagcctgaaataataaaaaactctgcatatgatgcagagttttttttattctgtaaaaggctgcggacgggtttttctatagccgtaccgataaagcagttcttccgcaatccgttttgaggccgatccgtcaccataagggtttgacgcctttgacatccgttcatactcggcctgatcggttaagagctgttttgtcagctgatacaccgtttcttcatctgtacccgccagcttcaatgtcccggctttcactccttcggggcgctcggttgtgtcccgaagcaccaagaccggctttccgagagaaggcgcttcctcctgaaccccgcctgagtcggtcaaaatgaaatttgctttcgcagcgaagttatggaaatccacgacctccagaggttctattaaatgcaccctgtccgaatcagcaaaatgggcttctgcggcctcacgaactgcgggattcaaatgaacgggataaacgacttgtacgtcctcaaactcttcaacgattcttctgacggccttaaacatctgttccatcggcctgcctaaattttcacgtctgtgcgctgtcaaaagaatcatcctgcttccttccagcttgtcaaaaatcggatgagaatagtcttcccgcactgtcgtttgaagcgcgtctatcgccgtatttcccgtgataaatatagaatccggctttttattttcagcaagcagattctgttctgcctggcttgtcggcgcaaaattcacatcagcgatcacgcccgtcatctgccggttgatttcttcagggaaaggagagtatttattttgcgtacgcagaccggcttccacatggccgacggcgatttgatgataaaaggcggcaaggcttccggcgaacgttgtcgtcgtatctccgtggaccaaaacgatatctggttttacttcttgaaacagcttgtccagtttcagcaaagcatgagatgtaatttctgaaagcgtttgacgctctttcataatattcaaatcaaaatcaggcgtgatgctgaatgcttcaagcacttgatccagcatctgtctgtgctgtgcggttacagtcaccagcgaatcaatttcctgatatttttcaagctctaatacgagcggagccattttaattgcttcaggtcttgtaccgaatacggtcattacttttagttttttcaacggtttgtctgcacctcgttttatatgtcggatatcccttcatgttaacatatttatgccgtttcttagatattgtaaagcttaatggcaaacaaagcaaaaaccgttacaagactctttgaaagcggattaaaaggtgtgaattttaatcaattgtggtaaagtggaaaaagactaggttatagttctgaaaaaaagattttgcagaaacaaggatggtgttattcagtgaagaaagtacgcaaagccattattccggcagcaggtttaggcactcgttttttgccggccacaaaagcaatgcctaaagaaatgcttccaatcgttgataagccgacaattcagtatattatcgaagaagctgtcgaatccggcatcgaagatattattatcgtaaccggaaaaggaaaaagagcaatagaagaccatttcgacaatgcccctgaactggaacgcaatttagaagaaaaagggaaaatcgaactgcttcaaaaagtgaaaaaatcgtcaaatattgcggatatccactatattcgccaaaaagagccaaaaggactcggtcatgccgtttggtgcgcacgcaacttcatcggcgatgaacctttcgccgttcttctcggcgatgatattgtccaggctgaaaaaccgggacttcgtcagctgatggatgaatacgaaaaaacattgtcttccatcatcggtgttcagcaagttcctgaaagcgacacacaccgctacggaattatcgatccgttaacaaatgaaggccgccgttaccaggtcaaaaattttgtagagaagcctgaaccgggcacagctccttccaacttggctattttaggaagatacgttttcactcctgaaattttcatgtaccttgaacagcaggaagtcggtgcagggggagaaattcaattaacggacgccatccaaaagctcaatgacattcagcgtgtcttcgcttatgatttcgaaggaaaacgttacgatgtcggtgaaaaactaggatttatcgagacgacgcttgaatttgccttacaggatcaggatatccgccataaattaattccgttcatgaaggatcttcttgaaaaagaagaagctgacgaatagaaaaagctgccgaatccggcagctttttttatgtgatctttactttttagacgttaccgtcagtgtcttatcagcattgttcacagaaaaagtatattcccggtttttaagcatgagcaaattctgattgattttgctgccgcctttttcacttaaagctgagatgtctgcaggacgcgataaatgaaaaaccacttcggagactgtatcattgtcaatcactacatccgtttttgcatcggatgcttttaatacgttccgtccgtcagccgtttgtcccgcagctggatttttcaatttacgctgcacatcgtcccggcttttattgagatatgagagaaactcttctgctgtttggcttgataaactgccgctgaaatcattcagctgaacatccgtcttttttaaagcgttcaccttatacagatcagtctttttcataaagtactctttatcgtttaatttcactttagccgcctggttattctcggcttctatctgcaccttcgtaccgaaacttacacttgcggaggcttttccttttatatctttttcagtgtaaaggtccgccttttcagcttttaccaaagcaggtttattcacagactcataaaggccggcatcgctctgtttgacgtcaccgaaagatgtgatcgcacgcagaggcttgtctgaaaacatcgaagcgcctgcgccgacagccagcaatgcaagcagcgtaatctgtatcgtattggcaatgaatttaggcttcgctttcttttgctgcgcctgagtgattttctgttcctcggctgcccgcgttctgccttcaatctgctcgttttgatatttctttttttctttctttgaaagcttgttgaaccaatccacaaaagctttatattcttttacaacggctttcgtttcgtcgaacatacgcatttcgccgtaatgcatccaagccacccggtcacacattttctcaatctgtccgatggaatgactgacgaaaaagatcgttttgccgcgttctttaaattccgtaatgcggtccacacatttctgatagaaagtctggtcccctactgagagcgcctcatcaataataaggatgtcagggtccatatgcgccgatatggcaaaaccgagacgggatttcataccgcttgaatagcttttaacaggctgatctataaagtcgccgatatccgcgaattcaacgattttttcataaagctcgtctatctgccgattgttgagacccatcatcaagcattttaaacggatgttgtccttgccgcttaattgattgtttaatccggcagaaatcgcgattaaagacggctgcccgttcatatcaatctcaccgcttgtcggcggaatgatctttgcaagcagattggacatcgttgattttcccgagccgttgatacctacgaatccgatcgtttccccttcatagacgtcaaaagaaacatttcggacagcgaaaaaacctttttgatttctgtttgggaaaaacaatcctttaattttgtcagactgttttttatatagaaaatactgttttgaaacatttctgaacgaaacttttagtttcatcgtataatctccttactatattaaagaaagtcaacaaacttatctctgaatttcatatgaagaagtgaaccgactgttaacagcagcagtgtgacgaaccagaaatacagcgtgtatttcacatcgtggaaaaaccactgcccttccataaagctgtctctgaagccctcgataatatagaaaagagggtttaacttcaagatggtcaaaacttcaggtctgtttccaaatttctccgcaatgtcccagaaaatcggcagaagaaaaaagagaagccttgtgacggcttgaagcaaaaactgatagtccctgattaatacgctgatggttgaattaaacaggccgaaagcaaacataaaactgatcatgcaaaacaagtaataaatatattgcagccagtgaagcgtcgggaacagtccgttgctcagcagcacaataatataaatcgccatcatcacaaagtaactgaataaattcgatgctatcactacagaaggcagtgaactgatcggaaagttcattttcgacactaaatttatccgtttaaaaacgctgttagatgcatccagtatcgtcggactgataaagaaccaaggaattaagccggccagcatccagacgatgaacggtacgctgtctccatttccaagcaccatatcatgtccgccgcgaatcccgaggccaaatacgaaccagtaagccagcatttgaatcatagggttgagaaactgccacaatatacccaaatagttcacttgatactttgatttcgtttcgtacactgcaagccgcataatcagcggaaatgagttgaattgctctttcagaatttttaccaatgcattcattctaatcttccttagtcgtaagttttaggtaatagctttgacttacaaaagcaccgctcataattgtaacagattacgatgtatttttcacttcataacaagcctgagtcccatgagcgcaacatgccgtcacttaagcaaaaaagcataattaacatggttaaattatgcttttttgcacttatttacttgtccccgaaaatcacttttacggctttttcagacgattctccggtttctaaataacagaacttctcgtaaaaaggcccgaacgaatccggaagcttataatcatctgattccgtttcattgacccatttgataacgtcacctgtttctttgacaagcgggccgggcgcttctttttcaaagtcaaagtaaaaccctctgagtttatcccggtacgtttcgatatcaggcacataaaacagcatcggtcttttcagattcgcatagtcaaaaaagacagaggaatagtccgttatgagtaaatcagagaccatatacagctcacggatatcttcgtagctggagaaatcatacgcaaatccttcatacggtccgagatcaaagttttccgccacgagataatgcatccgtaaaataatgacataacggtcgccgatcgcttctctcaattggtgaaggtctaaatcaaggtcaaacttgtattttcccttcttataaaattggtcatcccgccatgtcggtgcgtagataatcacttttttatcttgcggaagattcattttttctttcagcgctttaatgacagaagggctgttatccgtttgaaggaagtcattccgcggatatcccgattcaatcatggttttattaaactgaaacgcccgggcgaatatttcggttgaatatgcgttcggtgaaatcaggtaatcccactttgaagcctctgtcgtaaagttgcgcttgtatttttcagtgtttgttccgggcatatgcacttcatccatatctacggcaaggcgctttaaaggcgtgccgtgccatgtctggacatatgtcgtatgctcaggtttcggaatccacagcggcatacggctgttgacaacccagtactcggctcttgccatggcaaacagccatttgaacgtgaagcgttcgatataaggaatccctttatctttaaatgtctgtgagtaagcggggtttacactccagcaaagacggtattccggcatctctttgctcatgtattcataaatcgcccgcgggttgcagctgtactgttttccggcaaagctttcaaacatgacaagtttctgtttgacaggcagttttcctgcaaatctgaatcctgctttgtaagtgttctgtattcttttctcaatgaactttttcagcttattctttctcctgcgtacaaaggaagcgccccgtttcagctttcctttcacaaaatactccacgcgggtgctgaagctgtaatcgttcattctcaggtggagatttttcgttttctttttcgtgaaaacgtgaaatctggcaggccctttttccgttttaagaatcgtgaattggttagggtttacatgttcagatttcagaacctttaacggtttgctgttggtgataatctcttcacctgtcccggcatcttcaaaaatgaattgaatatggaattgaaagatgagctgctgattcaattctttataaacggcattcaaatcaatttttgtatcaaagcctatcgtgtcaagcatcgttgtgtcctgaacatattcatcaaggtcgtgtctcggcacgtcgtgaagcggatacttcagaatgagaggctcctcttcttttccttttttcattttcagaatcaggtttttttcttttatctttaaggtttctgccgcattcagccggaatgcaaaacctttcagatgtaagctgccgtcagattcgagctccatttcatcaatccgcgtgacgaactttttctgcagcagctttaaggagaaattccctttcttcgtcgtgtaagggaaaaagtacatatgatgagcctcatctttataagaagacagttcaataggttcaaggctggattttaaccgttttttactgatatcactgtcatcattgataaaggagacatagaaatccagacatcctttgccgtccgtatggtcagaaagcagatccgtgctcatgacagcatggtactctccgccctctccggccaaccgtttcagagggacggaaagttccgcttttgttttacgatttataatctgaagagaaggctcttcccctgcagtgacattttcacaggatatcgtaatgttgaatgtctcttcctttatgttaagatgttttaacttgtatctgacaggattttctatacccataaaataagtctactcctctgtttcaattaaacatatccaatcacaatcatcattttgttactttcagtgaaaggttctccttcaccgtccggtagaattgatattgcagtccgttcgcttctgccgtcaccttttcaccgtcttctctgtttaacatgacacgttcataatcgttataaatgacatacataatataaccgccaagtccgactttttcaatgtcacttaacgggatttcaaggacgtaccgcccgtctcccagtgactgaaccggaaactggtggtgtactttcatgttatctctgtgctgaaactgaatatattgggcattatttctgtcctgtccgaacaagcggaacgtaacggtgaatttatgatcggcgaacaccgcgctttccgtttctccgtgcatgcgaagttcgaccagtttattttcttcatccgtcagcgggctttctaaataagccagtccgtctttcgtcacgatgtttttatcgggctcttttttggaccagcggaacagcttttcgacctcatcataccgtttttgagtcagcagacggtaggctgttttatgaatcggatgaaaaaatgtctcggaaatatcgtatttcgtcttctttaacacattcagaatttcattgaatttattgtagtaggcttctttgttttcgcttttcaggaagtgcatccgatcgaaaagccgcgtaatggaatcgaattcaatcaggcggttcatcgccatcttctctttttcagtatctaattttttgttcagaatatacttcattacggctatgttcgtgtcggttttttccattatattggtctgctttgtcagcgactcattattgtccattctgttcagataatagaccggttcggttgacgttgaaatatctccgcacgccaaaagaacatccataaaaaattgcttatcttcagcaaatttcatttccggatatctgatatcgttatcttttagaaattgtaagttcatcattcttgcccgcgggcccagatgatagaaaatatgccggattgaaaaaggcgataccttcgctctgttcagcgaagactcatgtttcccgatcgttttttgaccgttcacctgcatttcgatcgtttttccgaccgcataatttacatgatctctttcaagcatgtcaaataagattttaaccccgttcggcgcaaaccaatcatccgcatccaaaaatgtaatgtacttcgcatttgccagctcaattcccaagtttctcggataagccggagttcccgtgttgtctttcaaaaagacgactgtaatattttcatacaattcggcgtactcagtcaggatgtttctggaatcatcggtagagcaatcatctaccagaattaaagaaatatgctgaaagccgatgttttgaaggatcacagaatcaactgttttccttacatattcttctgcattataaacaggaacgactaccgctaccttcttctcttccgccaatgcttctttgtttaaaatggtatattcgcgttcttctatggacggcttggactcttttttattcaacttaaaaaagttactaagattcatctttaaattctcctcttattgtctagctttttttcaaaagcgcataacaaatatagcgaaaataaccttatattacaagaagtactccctatccggagggagtacttctttatcatctgtatatccgaatgtttcaattacaccccggcaatttcttttttaatctgtgtggtggaaatgccttcggttctagggagatagatgacttcgcattgatctttaaggaaatcgaatttgccttcccaatcgtctcccattacgaacacgtcgatgttgtgatccgctacgtcacgtactttttgatcccagctgttttccggaatgacttcgtcgacataacggattgtttccagaatcagctttctgtgttcatagctgtggtaggcctttttttgtttttgcaggttgaactcgtctgttgagatggcaacaactaggtaatctccaagctgctttgcgcgctcaagcagtttaatatgaccccaatgcagtaaatcaaacgttccgtaagtaatgaccttcttcatgaaacaaaagctcctttctatcatcatacgtataacaagcaactgccctgaaatgctgcgcagctgtatccttaatcactaaagtgccaatttcgtactcatggaacctcattatatcacatagccctgaaaaggttaagctaatgtaaaacgaagttaaattccacttattaacaaatgttattacaataggagtttagcagggtttttgcgcggttgattaaagaaattgttatcttatttatatttttgtaaaactattgttaagtttatctgaaggtattatgttaaaataaagcttagcttaagtcacgaaaaaatgaaagaaaatcccgtacaaaaaggaggacggcagatgcagactgaaatggtgcacaacctttcttatgttaatggaaatttacaggagtttatttcatatttagacacttattatatcgcgcaaaagcaaggagccgtcattgcgacggtcaaccctgagatcggatacgctgcggcgaaagacaaaggttatcatcaagtcatttcttccgcggatttcgtcctgccggatggtatcggcgtcgtgttaatgtcacgtttgacgcagcacccgctgaaatcaagaattgcgggattcgatgtatttctgtcgctgctcggtctcgcaaaccggcagtctaaaaaaatatttttatacggagctaagcaagacgtgcttgacgccgttttgaaccggatcggcaaagagtatccgaatattgaggttgtcggagccagcaacggttatgaagcggataaacgcttcgtcgccaaacagatttcccgggcgaaacccgatctcgtgtttgtcgccttaggatatccccatcaggaacaatttatttatgaatacaaacatcttttccctcaggctgtatcgatcggtttgggcggaagctttgatgtgttcagcggaacggtgaaacgcgcccctgaatggatgatcaaaacgaatctggaatggctgtacagactggtgacgaatccgtggagatggaaaaggatgctgaacattccgaagtatgcttttaccgttttgagaaataataaatcaaataaaagcctgtattccgagcaggcagaagatcaaacgaaacagctttaaacaaataaaacagcaaaagagattggtaatctatgaacttgcgatctttattcgccgctttttattctatatatctgtctgttctgggcgttttgttcaagcctgtaaagcccaagaaccatctgaccctgctggtatcttttgaagagaatgcacaggctctcatccgttcttacaaagcgcacgctgaatcgctttcttatgaagtgacggttttgtatacgagacacgccgtcagtctgaaaaaagagctggaaggactcggctctttttatctgaacgaaaaacatccgctgcatcttttgaaggcggttttgatcctttttaagagcaaagcggtgataacggataactatttcctcatgacaagcgtcttaaaccgccggccgcaaacgacatgtattcaagtgtggcatgcgaacggctctttgaaaaagttcggccttgaggatgtgacgaatcaaaaccgtccggcatcagacatcagccgttttaaaaaagtgtaccgctcgtttgactttgtcaccgtcggttcagacgcgatggctgacgtttttaaaaagtcgttcggcatacgggacggccagctgttaaaaacgggtgtccccctgactgacgtctattatgaagaacacaagcccgaaccgaagcacaaatggccgaaaaaaatcatcctgtacgcaccgacattcagggattatgatatgcagtcctttcggctgccattcaccgaagaacagctcacaaacgcgttaaacggagagtatatgctgcttgtaaagcttcatcctgccgttttgcatcatatttcggcttcgtttgaaagcgaattgatcaagaacgtgtctgacatgcgtcttcatgatctcttgaaagcggctgatattttaattacggattactcttccgtgccttttgaattcgcgctcttaaataaaccgattttctttttcacgtatgatctggaggaatatgatcgaaaacgcggtttaatcgacaattatacttccgtcattcccggaaaggcttgtcatgacagtgaagctcttttggaggaaatgacgaaaaagccatttgatgcagaagaaatgaagcggttctcggacaaatggaatatgtattcagatgggaattcgagtgaagcgttattgaaatttgcggaaacaaaaatgaaaaattgtgctgaagcacctgcctgaatctgaggcgggtgttttttgcatgaagaaagggctgaagcatacacttcagccctttttttatactttcatatacacgggaacatcatagtaaagcgtatagtcatccagcagtgagtataagctgtacatgcggtttacctgcttatacgcccagccgatgtctgtcgcatactgatgagccgcggctggagaccatctcattttatacagcgtatcctgctcgtatgaaggattgtgaatataagacgcaccgataaattgggctccgccgataatcgcggcttccggagtaaaccagccttgcttatacgcgtattgtgcgccgtagtaattcgggttgctgtcataagccccgatgccgtacatgttgtaaacctttttaccattatacataatgccgttcgcaagctctgacgtgccattgcccgtttcaagcaaagcatgcgaaatcaaatacacttcattaatgctgtatttgccggcggctgtaataaaggcctggcctttccctgtcagtattcctttattgaccagcactttttgattcagttccgatgcgttcagtccggctgtctgagagagcttcagaaattgaaagtaatacttgctgtcttgtgcgaagtgagccggattgacgtactgcccgacttcgtcactgctggcgtttctccagcccatgctgagtttggcccagccgtttgtctggcctgtgatgctgactttatcgccttttttcaactgcccgataatattgcctgagctgacttccggggttgaccggacgttcaggacgtcggctgtgaccgttccggaggccgtattgatgtacgtaagcgatgcataagccgcggcatcagtctgcgggctgactgtcatttgttttttgaccatatctgccagcgagatgttgtaattggtgttcatgatttgcggtccgttttttattttcagaatagccatcgtccatccgtacagctttttcagcttttgggaggcggcgtccgctgactgcgctcccgtgaattgattgcgaatgcggagttcataaaccggatggctttcactcgtatagccggcctgtaattgtttggcgctgaaaaagctcatgcttttatttaaaacggttttactgctgaatttttcggttttgatgacgtattgtgcagagccggttttccccgtctccttcacagtgccggccgctttgttttgcttgaaaaaagcagtcacgcggtcaatgtcttccttcttaagcagcggtgccgtttcaattctgaattgtgtatacgccgcttcacctgttttctgtgcggaggcggatacttttttccctttgaaaaaatccagcgattgattgatctttgccgtatcaagcagtgattcggttgtgacttggtacgttgtgtccgtctgcttggatatcgtttttgaaatggcagtcagtttatatcccgccagcagattcaatcctttttttatcttcgactggtctgccgtctgctgagaaagcagctgatattcgttttctgctgtttttcccgccgctgttcttgccgtctttacatgctgctggcggaaaaacgcctccgtttgatccgcctttgcagcggtaagctgccctgccgtgatccggtaaacggacactgatgctgtctttttgacaggcgatgcgtcgcaatgccattttttctttttaaagaaagcttgcacgctttgcagctgtttagccgtcagtccgctcatcgcgaccgtgtaattattcttcttgccggctttttgatagcttccgctgacacccgtattcttcttgatttgggtgatagcattttgtacggcgcttactccgttaaaatatcctgactgcacgttatacacggttgctgttttgctttgggcatacttttgaacgttccctttgacgcctgttttctgctgcagctgtttcgctaaacctgccgcattatttgcatttaaaatgtcagaggctgtcacggtgatattcggactggcctttgccgtgactttcagcgacgactgcaatcctgtttccttttgaaaatcagtttgaatttgagcggctttttgatcgccggagattgttcccgattggatctgaaaccgggctgtttcccgtttgatctgacggtatgacgctttcacgcccgtctgcttcgtcaacgcttgcgagagcgcttttgcatccgcatcggccgccatctcagaagtcacgacctgcttatacggctgttttgtccccgccggcttgacggcgccggtcacgcccgtttttttcgtcagttcggcaagaagatttttcgtctgccgctcgtctgatagaacgcctgatgtgacggtcacgtacggctgtttgcttccgcttgcgctgtaagtgccggccacgcccgtctgcttcgtaaaatctttcagcacggttttcgcatccgtttcatcgtgtaagcctgaagctgagatttgataagtgagcggcgcatttccggctttctttgcgtcagcctgccaccccgtatcctttttcaatttcgctgccgcttgaagcgcctcgttctcagaagcaaattgctgcttcgtttccagctcgtaaacggagtagtcgctgtatgcggcctcggcgtgctgtgtaacggtgctaaagacaaggaaaacggcggacaataacataggtgcaacgaatctctttttcattccttctcctctttctgattcaattggtttctatcaaactagtttatttatcggcccgctttcttcatttttacagagagaaatcatccaattatccaaataaaaaaaacttaatcccagagctgggattaagtttggttttatatatgagaaacgatgatcgtgcaatctccgtttatcgtaaagtcaggcatctgatccggcagtatgaaatgcgcgcctttttcaagcttggcggacttgccttcaaagatgatggagccgcttccttctgtgacgctgcacagcataaacggagcgtcctgggtcatttccgccgtcccgctgatatcccatttgtatacagaaaaatattctccctgcacaaaggttttaatggtgatgccttttctcgtttcagttgattcatccaaaaatccgtccacatgaggaacggtggcggcgttgacggcatcgcggatatgcagctcacgcgccccgccgttttgatctgtacgcccgtaatcatatatccggtaggcggcgtctgaattctgctgtatttccagcacgagcgccccggcgcaaatggcatggatggttccgctcggcacataataaaaatcgccgggtttgatcttcacgcggcgcagcagaccttcccagtcaccgctgttaatcatggtgacaagttccgctttcgaacgggccgtatgaccgtatatgatttccgcattttctttacagtcaataatgtaccagcactcagatttccccgtttcgccctgtccatgctcctcggcgtcataatcgtcaggatggactttaacggacagaggatgtttggcgtccagtattttcgtcagcagcggaaaccggtccccttccgttccgccgaataactctctatgctgatcccacaggtccatcaaggttttcccttgatacggaccgcttttgaccgtgctcattccgtgcggatgggctgatatcgcccagcattcgccggttgtttctgaaggtatgtcatatccgaatcgttcgcgtaataacgtgccgccccatattttttctttacatacaggctgtagaaaaatcggctcttgcgtcatgttcgttcccctccccttaaaaagcggctcatatcccattccccctgtgtcttttttaaaacacggagggagccgcggttaaaaacaatatgtataaaatggctgacctgctcattataccattcggatggggcggaatgctcagtcatttcctattccagaataaaatgccttgtttgtcgcaaattaaaataactgatggaaaggggggaacattatgacgatacatgcggagctcggcaaaaaccttgaagcgctgaaaaaacggatcggccaaagcgatgacatgatgttttattcgtttacgtacggaaacggcaaatgtgacgcctgccttatatatatagacggactgaccgacaatcaattgcttgcggaatatattatttcgcccgtgcaggcggccgccctgcatcaagaggaaccggctgaaataccgccgtcatccatctctttcggctatcgtcacacccggctttcttcacttaaggacgcggaggcagacattttttccggcaaatcggttttgctggcggagggatgggaggaagccctttcgtttgaaacggaaacatttaaaatgcgtgatattgaagaaccggcttcagaagtgcttgaacggggacctaggataggttttgtcgaaaagctccgaacgaatacggcgcttttgcgcgagcagtccggtgatcccaacctccagatcaaagagatcacactcggcgaacggacaaaaaagcggatcgccgttgcctacattcgggatattgcgcctgatgatgttgtaaaagaagtgatgaaaagactggattcgatcaccattgatgacattccggaatcaggaacgatcgagcagcttattgaagataacacgtattccattttcccgaccgtcttgacgaccgaacggcccgaccgggttatgggcgctcttttggaaggaagggtctccattcttgtagacggaacgccttttacccttttggtgccggctaccattgatgaatttatccactcacctgacgattataatcagcggtgggttccggttaactttctcaggctgcttcggtatacatgcattttaatcacgatttatttacccggcctttacatatcgctcgttacgtttcacacggggcttttgccgacgagaatggcggtgacgattgccggaagcagattgaatgttccgtttcccccttttgttgaagcgtttattatgatttttacgattgagatgatcagagaagccggactcaggctgccgaagccgatcggacagacgatcggcctgatcgggggcgtggtgatcgggcaggccgccgttcaggcgaacatcgtcagcgcgatgatggtcattatcgtatccgttacggcattggcttcttttacggcgccctcctatgcgttcaattttccgctgaggctcatccgtattttttcgatgattttgtcggcgatattaggtttatacggactgatcatgtgttatctgcttgtcgtcggccatctgatgcgcctgaaaagcttcggccaggactatcttattccgatcatggcgcagccgggacaggacttaaaagatacgatcgtcagactgccgacgcctcttttgaaaaaacggccgaccagaaaagagacgaaagataaaatcaagcaaaggtgatcaccatgaaaaaaccggaagacaagctgtcgtttatgcagacacttctcatggtaagcggaacaatgatcggagcgggcgtgttaacactgccgcgctccgccgcagcagcggacagtccgagcggatggatcattattcttgtgcagagtctcgtgtttatcggcatcgtcctgctctttatgccgtttttgcagaaaaacagcggggaaaccatttatgagctgaatcaaagcattatgggacgcgccatcggttctcttctgaatttattcatcagctgttattttgtcgtcaccgtctgttttcaagcccgttttctcggtgaggtcatcaattactttttactgaaaaatacgccgatgggtgtcgtcatattcatctttctggcggtcggcatctaccatgtgaccggcggggtgtatcccatttcaaaactctatgcttatctctttccgattgcgatcgtcattctgattacgctgctcatattcagcctgagactgtttaaactggatttcatccgcccggtcatggaaggaggctacaaaagcttttttgagctgtttccgcgtacccttctgtatttttcaggacttgaggtgattctttatctggtgccgtttatgaaaaatccgaagcaggcgaaaaaggctgccgtcttcggcatcgcaggcgcaggcttattttacagctttacgctgcttgtcgtaatcggctgtatgtcgatcgctgaagccaaaacggtgacatatccgaccatttccctgattcacgccttggaaatccgcggtattttcatcgaaaggtttgatatctttcttttaatcacgtggacttgccagcagttcacctgtatgctcggttcttttaaaggagcgcatctcggattaaacaccattttcagactgaaaaataaaaacaatgcctggctgctggggggcttattggcagtgacattcggcctttcaatgtaccccgatgatatcaacagtgtgtttgcattcgcgaatattctcggatatgcgttttttgccgtcattatgattccttttctcatctggtttgtcagctggatgaaaaaaatagccgggaggaaacagacgtcatgacacatttcgtaaaatgggcggcggcgcttttcatactgatgacgctttcagggtgctgggatgcgaaggaagtcgaaaagctatctttcgcccgggggctggcgatagacgagacgagtgaccgccgatataaattaacctatcaaaacctgctgccccaaagtgaaaacagccaggcttccggccggcccgtgtttgtcaatgtgacgacgcggggggataccattcttgaagccgtcagtgaagtcgctttaaaagatccgcccgtttacagcgatcatttaaaagtgctgatattcagcgacaaattgctggccgaccaaaatatactgcagatgatgaatcattttatccgtgatgatgaattaaggcggagcagctatctcttcgcggcgagaggcaaagcgtccgatattctgacagagccgacgccgaatcagcagcagcccatgcccgcggaaaagctgatcgaccttacgaacaacggcggctacaacgggaagattttaaaaccgctccgaatcgggagagcttcgatttactgccataataaactcagttttctcattcaggccgtcagcaatcaaaaaggaaaaacggtgtatgacggagcggccattatcaaaaacggaaaacaaaacagattggcaggctttctgtcatcatacgaagtacaaagcctgaattggctgacggggacgatacagggcggcgtgctgcccgctttggataaaggagggcacccgattaccttcgagatcaaaaaatcaacatcctccatcacccccctgctgaaaaacgggaagctgtcatttcacgtagcggtgaaaacaaaaggacttttgtcagaggatcaatatgccggagaagattcattcgatcagcactatttaaacgggctggaaaaggttttcgaaaaaaaactgaaaagcgatatgaaagaagtcatcgataagctgcagaatcaatatgaaacggaccctgtcttcttttctgacagagtccgcattcaatatcccgactattggaagaaagtgaagcatcactgggatgaaaccttctccgaagcggcctttgactatgatgtttccattcagattaccaacttcggaacgatgggacggtagccttcagcgtgttttttcgacacgaaggagaatctgataaatccggctttgttcgggcagctgtgtcaccggaaattgcatcgattgcgccattcgtgtgatttcctgtaaaaacagctgcacccgctcatccacgtgaacatacgtataggactgctttttcacgtcaaatgtctcttccggaaagagcgtgcgcaccgtctgcggcgtaaaaaaccgcaagtgggtgcggtcgagaatcccggcgtctctgtatgtccagtccccgagcagaagcgggaacagcgcttcggcgtgggaaatattcggaatgctgcaaacgattgatccggcaggcgacaaataggatgagtacgtttcaatgacgcgccacgggtcttttaagtgctcaaggatgtccgcgaaaatgatgcaatcaaaaaagccttccggataaggcagcttcactttttcgacatcttcctgcagcaccgcttcataatgtccttttgccgcttgcgccgccagcgggtgcagttctattccgtacagttcgcaaggctgtctgttttgaagttccagccccgtagctcccgcaccgcagccgacatcaagtatccgtttcgcctcccggggaacgagctccgcaatttccggtctcggatgagtaaagtacgtaaaatcagtgccccatttttccgtaaaacgctggcggttctccgaatataactgattgatattgatatcctgattagccgtaaacgtcgcatgcccgtggtgatgcacaaaggcatcgagagcgatgtgcaggctgtatcctttttgcagggcgcgcagacataggtcatcatcttcaaaagaaccgtatccgaattgctcatcaaacgggccgatgtcttcaatgacgctttttttcaccagaagacagaagccgacaaggcgcagcacccgctttgtttgatgcttttcccgtgcacaatacgcctccgcgaatgactccagctcatcaagcgattgatacgcgtcatggatcatttgcgcgccgctgacatagttgctgacgggcccgaccataccggttttttcagattgatacagcaccctcagcatggaggtgagccaatttttcgtgaccatcgtatcgttgttcagaaacagcagattttctccccctgccgcttcgattccctggttgcaccccttggcgaacccgaggtttttttcattaaggatgactttgacgtcaggcagatttgatatgtattctctcgttccgtctgaggaaccgttgtcaactataatcagttcaatcttatctttgtcggtgtatcgttcaatgctggccagacattttttcgtcagctcaagttcattatatgtaaggataataatactcgttttcaccggcatccccgcctttatcgtgactttatacaacgtatgacatatccccgtcatttatgtgaccgtgcgggcgcccgcacgcatccgttttgaggggccggtgaataaccgcccccctaaaactgaatattacggatgaactgtccgccgatttgattctgatcccgagcctccgttacggcttttcagatcctgctcaatttcttcaaggcttttccccttcgtctcggtcactttaaaccggacgaacaggaatgccattattccgatagcggcataaatgagaaataaatagctgatgccgactgcttccattaacatcggataggttaatgagacaatcaatgttccggcatgcagcatcaaagtggagacacccgtcccgataccccggacatgcagcggaaataattcaggaagcatgacccacacggcaggcccccagctgaccgcaaacacaatgataaacaggcctaaacaaatcaccgttgtccatgatgcggctgctgaatgttcaaagaaaagattgaccgcggccaatacgagcagactgatgaccatgcccgcatttccggccagcagcagcggcttccggccgatcttatcaatgactttaatagccgcaagcgtcatgatgacattgacggcgccgattccgaccgttcccaatatagacgcggaattgccgaacccgacactggtaaatgttttcggtgcgtaataaataattgtatttgtcccgatgaattgctgcaaaaaggcaagtccgaggccggcaatcagcgcgggtctcacccacggctcaaacaattctttcaaaccgccttcgttttccttttccgcttctttcatctgatcaatctcatcatcaatattcttcgttccccgcaatgatgaaaggatttctcttgctttctcttctttgccgatcgtaaacagccagcgcgggctttccggcataaataagattccgatcagcagaatgactgacggcacaaccgcaagtccaagcatccagcgccaagcgcctgcatcggcaaatatatagttcacgatataagaaacgaggattccgaccgtaatcatcagctgattcagcgaagaaagcgccccccgtttatgcttcggagccagctccgataaatagagcgggacgatcgttgtcgatgttccgacagccagtccgagaataatccggaaaagaaccatcacctctgtattcggggcaaaagcgactcctaatccgcctatacaaaacagcagcgccgctcccatgatggctttccgcctgccgaaccggtcggtcagtttgccggcgaatcccgatccgagaatcgcccccgccaataacgaactgacgacgaggccttctgtaaaggcgttcagtcccagttcttttttcataaataaaatagctccggaaatgactccggtatcatatccgtataacgcgcccccgagagcgccgaaaaaatagagccatttattcgagtgtatgcttttcatgttatatagactcccttcatccaacgctgtatccgcgcggaattgttctactgcttcttttgcctgtttccgatcgtttcaaaccttccgcaccgttaatatccattattttactgattatttttcacaaagcgacgaaacatttcccgcttcctgccgtccaatataatgtgaacctgatgcaaaaataacagtagatgttgtcgaaatagagagaaagatttagaattttctcatttgcagagttgctccgagtcaacaattatggtacgcttcacaaagaatagaaacgagaggtaatgatatggaagaacgatctcaacgcagaaaaaagaaaaaacgcctcagaaaatgggtgaaatttgtactggtattcgccgctttcttattggtgatcgccggttccgtcggcacctacgcatttgtgaaattgaataatgcgaccaaagaagcgcacgtcagccttgaccgcggcgaccagtccgtaaaacggatcaaagaatttgacccgaagaaggattctttcaccgtattgcttttaggaatagacgcccgtgacaataagggtgaatcagtagatgacgcaagaagtgacgccaacgtgctcgtcaccttcaaccggaaaaagaaaacagcgacgatgctcagcattccgcgggattcctatgtcaacatcccgggacacggctatgacaaattcgcgcacgcacatgcttacggcggttataatttaacttataaaacagtagaaaacatgtttgatattccggtagattatgtggttgagagcaacttcgacgcgttccgcgatgtcgtcaatgagttgaacggcgttacggtaaatgtgaaaagccagaaaattgccgatcgtattaaagtcgatacaaaaggaaaagtcgtgctgaagccgggcgtccagacgcttgacggtgagcaggcactggcttatgtaagaacacgcaaagcggacaccgatctgatgcgcggacaaagacagatggaagtgctgagcgccattattaaaaaatctaaatcgttaagctcgatcccatcttatgacgatatcgtcgacagcttagggaaaaacttgaaaatgaacttatctcttaatgacgccatcggtctgttcccgtttatcacatcgctgaaatcggtgaattctttgcagctgacaggttcagacagctacatttacactcctcagtacggcaaaaatatttattacttcaagctgaatgaggaaaaccttcaagaagtaaaaacgaaattaaaaaatgatttagacgcgtaagatgtcacggcgggattagcaaatcccgccgtttttctgttgaaaaaaaggacatgaaggtatagccttttaactgacggctttctgctgatttcgcacaaagctgaacatactacatgaagcagctttatttttaaggagggcatccatacatatgaaattgatagccattgacttagacggcacattactgaattcggacagtgtgatttctccggaaaacagagcggctttacaaagagcggatgaagcgggtatactcgtggccatctgcacgggcagagccacgtttgatgtaaaagcgctcttgaaggatttggatattccgatcattgcggcaaacggcgggacagtccatgacaaaggataccgcctcgtcagccggctcttaatggatcagcaggccgggaaggatatcgccgcttatttaacggacaaagatatttactttgaggtctatacagatgatcatctgctgtccccgtttgacggcgagtccaaactgcaggcagaactggacattctgaaaagcgccaatcctaaggaagatattcagacattatgggagggcgcaaagacgcagttcaaacaattcggcattaaacccgtacaggatatacaggcgatttttaacggagacgaacatgtttacaagcttctttgtttctcttttgatatggaaaaactgagaaacgccaaagaagaaattacacatcatcggaaattatcccagacatcttccggaaaacacattatcgaaatcctccctgccggttccggaaagggacgtgctctgacggagcttgcctcactgtacggaattgaaaaacaggatatttacgccatcggcgacagcccgaatgatttctccatgtttgaagcggcggaaaaccgcatcgctatgggcaatgcgattgatgaactgaaggaaaaaagcacctatattacaaaaagcaacgatgaaaacggcgtcgcatatttcatcaaccggcttctcgacaatgggcaataaaaggtaaaagccaggtctttcacggcctggctttttcatgttttctaaaaaaggaatttccaaaattgaaaataaattgtaagataaagaaaaaaggagtttcatgatgtcgaatgcaatcgctattataggatttttagcttttctctgcgcagtcggatacggaatttttcatctcatatgcaaagcggcaaaaaaagaaaaacatttttcaaaaaagctgttttggcctcttctcatcggcggatttatcctgcttctgaccggcgcctccctcgcagagccggacgcctcggccgtgaaggcagaggagaaatacagcacccttgatacggcttatcaaaaattgacgaaggaacaccaggcgcttgagaaaaaatatgaaagcatcagtgccgcagccgaaaaggagaaatccgaagctgaagccggcaatgaagaaaaactcagcaaactcagccaagagataagcgagctgaaaaaaacaaacaaatcactcaaacaagacaatgagaaattaaaaaattcacaaaagaagctcgaaaagaccgctgaaacgcttcagtcagaaaataaaactttaaagcggcagaaagcagaaacaaaaacatccgaaaacgcggaaacggcgcaaaacaacgccccttcctccggaggacatgccgaaacgaaagcagccggcacctcacagggatgcgacattaaaggcagccggaacggcatttatcacacgccgggaagtacatactacgaccggacgacagatcccgcggaaatgttctgttctgtagaggatgcgatagcggccggatacagagcgccgaaacggtaaaagaaaaagacgtcagagacactctctgacgtctttttttacggaagccggatgccgcccgcatatttgtccttccaataagcgcttgtgttcaaatttgttatggtaacacctgcggacacggtgacatgaatcacttgtccgttcccgatataaatggccggattcaggctttccgctttaaagaagaccagatcgccgggcttcagatcttgtttatcgaccggaacgcccgcctgcatctgcttgtcggcataacgcggcaggctgattcctttcgctttttgatagatgtattgaacaaatcccgccgtatcaaagccggcttccggtgaagcgccgcctttcagataagaaattccgatatgatcggccgctgtggatacaacgggattgtctttagaaatggctaaattgctgaatcggcgcacccctgtgaaatgttttttccaataatcttccgccaagtaagaaatagtgactttttcggagcggcttgcttggatgaaccttccctctcccgcataaatgcccgcatgggaaattccttttttatacgtgtcgctgaaataaatcacgtccccgggctttatgtcgctcagtttgattttctcaccgaccagccactgctgttccgcagatctcggcaggtaaatgtgaagcttgttttcaaaaacatattggaccagccccgaacagtcgaatcccgcctcaggcgtgcttccgccgaatacatacggaatgtcgaggtaacgggctgcctcctgaacgatcggatcatcagccagttccggatcttttgtcatccgctttgcgccaagatataaattcatccaataactgcttttttgaaagcgtgtgacggttacgccttctgacggagaactgtgtatcatctctccgtttccgatataaagaccgtcatggacgggcgcgttttgtgttgaatccgactttttgaaaaacacaagatctcccggtaaaaggtcattttctttgacggcggctccgactttccattgatcactgaccgttctcggcagatggatgttctgcctgctgaaaagataatgcatcaatccggacgggtcaaaaccgtcctcaggctcttcgcctccgtaaacatatttatttccgacaagtttttgcgcgtctgaaacgatcaggacagaaacttgagaatccgcttcggcaatttccgttctcgttactgcaggtgccacaagacaaatcataaggccggcaaggatgtacttcctccagcttgtgagcatgttttctattcactctcctcatttttagtagtttttacatcggtaacttttaacaaatgtttaggagagcacacaaaaaaagaatgcccgatatgggcattctttactggattcggaacaaacaatatgccggcaagcggaatcatgcgcttattttgcgcccgctgtgtcctcttgctgaattttttgcatttccgtgtcaattttttgtttttcctgatctgtgagctgatcattgtatttaaacgcagacataaacataaacaccataatgatcgcggcaaacggccatcctgctttaatgattttcatttgtttttcactccgctttcttttttaagatatcgctgtgatccacatcaaacgttaattttccatccttgacgctccacttgaaattcgattctttcgtcagttcacgtacgatcgttttatgattgatgctgccttttttaaccggtgcaggcgttgcttcatgaatgttcatcggcgtgacttcaaagcgtcccgtaccgtttttctgcagatgatattgaacaagcgccgtgtctctcgttcttgtccacccctggtcgaatacgaagttgcccaggctgtagaaaataacggtgccgtggtacatttcgatcggttccagcacgtgcggatggtgtccgacgataatatccgctccggcatctgacattgctcttgccaattggcgctgtctgtcattcggatcattatcgtattcctgtccccagtgtgtttgaacaatgacaagatcggctttctttttggctttagaaatcatcggaataaacagctctggatcggccggaagcacacccggcgcatttcgtttagctgcaaaaccttttccggaaacatcagtgaaacccagtgttgcgattttgattccgtttacatcttgataagaaatgttctgctcggcttccttcagcgtgaggcctgctccgacaagttcaagattttgctttgaaaactcttcaaccgtatcccgcattccttgagggccgtaatccatcgcatggttgttggctgccgtgagaactgtgaaattcatgtccttcaatacttttacggcatctttgtttgactgaaggtggatatttttttctgcttctttgtagttctttttatatgtaaccgggttttcaaagttccctgacacatagtcggatgattcgaagaatggctttgcataacggaagacactctccgtgcctttatgctttgtcactttctcgacattccggcccatcataatatctccgacgaatgaggctgatacaaggtcatcggcatttcttttcacactcggcgtttccgccttccctgtcaggatgcagacgaacatcaggcaaaagacgatcggcagcgcgataaaaacgtgaagattggtcttctttttctgctgtttggtcagcttcagcagtttttcttgaaagcttaattgttttttcatcgtttgacacaccttacattagattaagtagtaagcaaacataatggcaaaagttgcgccgcttaagaacagcgtgctggcgaatgtaatcgttaatccctgtttctgaatggtattggcgatcagacccggtacgatgataccgattccgcggaattctgatatctcaaacggtacgatcgggtaaagaaaatcaagggcgatttttaagcagattcccgttatcagcatagctgcgaattttctgcgtccgtacaatatcataaatctggataaaccgtatttgacgatcacgtatgtaagaagactcaccagcagtacgagtaaaataaagaccggctggttaaatacgagccctaaataacccggcacaactaaaccggcaggtacgatacctgttttttccgcgaaaattaaactgattaacacgcctaaaataagtgaaatgtataaatctgatccgaacatttatccttttcctcctagctaacgagctgtttcaccttatactcttggattttttcaattaatggttccgctgaaccgtggatattgccgacgccatatatgacacggttttgcattcttgttttcagcacgtccatgatttcgtctgttgatttatattccagatcgtgcagtgtatcggcaggaatcttgccttcttcataagctctgacgatcggttctgtcgtctcgccgatgagtatgagttccttcgttttaatgtacggaagcacgtcgtttgcgaactgaatcgttctgtccacacggtcggcgcggcagttcatgatgacgatcggttcatctgtcgggtagccgatttcctttacacgtttccatatatttaaagtagaagatgcatcatttgcggcaaagccgtttacgaaatgaccgggctccttcgtgctgagcagcggcaggattctcatggcgccaggatcaggcggcgcattcagcattcctttaaacgccgtttcttcatctatcccaagagcctgggcaacgccgagcgccagggaagcgttatcaggaaagaccatatattcaaattttcgaaggtattcatctgtaattttagagttatccgcaataatgacctcggtattccgctctgcggctttttctttaaagaagtctgtgtattcactgtctgtaatgacaaggtgaccgttatacggtatcgtcgcggtaaaagcttcagcaatctcatcaagcgtcggccccatgacatccatatggtcttcaagcacattcacgatgacgccgatgttggcttgaaggagttcttcctgaaagataatctgataatccgggtttaccgccatacattcactgacaatggcattggcgccccgttctacggtttccttcattacttctttttgctcgccgatattcgggccctgcggtttccgtttgatcggtttctcctcaggtgtatcccaatagatcatccttgcatctgttcccgtcgtttttccgactgttttgtagcccgcctccatcagtattccggtcgtcagcctcgttacggttgactttccgcggataccattaatattgacgcgtactggcagagcatcgatattcttctgatgccgccttttttcaatgattccgatgattagtacggcagcacaggctataatgagtaaccacattgatttttgacatctccttctgtattgataaattcattcatcagtatatagcttcactatgaattctcaatcggcattatgtaacataatcttcccgctttcactgagccaaacttctctattagtgacgctattcttcctattatcgaattgctttttttgggaataggcaggacttaaaccttacttcaatttttcaaaagaaaaatgtatgcgtttacatttccacacagaaattcatttggaccaatgggactatacgcgttccggaagaaaaagatgtaatgataatccatcttttacagcctgttatatcagcgttttccgcactgcgcatacgtttcgggactctatgtccgctgtgtgcagactgcctgttttgttaaggataaggtcttaaagtcattcatttttcccccgtatcctgctttcagtcccattccaaaataactagcggaatgactggtacgtgacagaaaaagacgggtccggagtgtttacaagaaatacacattttatatgcggaaagcctatctccttttaaagcatttacaggacatttatcactcttttgaaataattttaataaatctttatattcgttcaagaaatattcatccataattgtgaagttcttggtaaaacgtcgagaaactcctctattttataaaatgcataaaaaaggaatacccgctgaaaactacagataaccgggaaaggaggcggtctgatgtctgcggataaacaaaacaaacggatttccggcgattttgaatcggctgtacgggaaatgcaggagctgatgtgtgtttgcggtgattttaaaatacgaaggatcaaactgcaggaccgtcataccgctttcttttatattgaacaaatgatagaagaacagaagctgaatgagtttctgttaagcgacaccctgcagaacggtccgcttgaggaaacgatgaatgccgtcagcagtgcggaaacggatgaaaccagaaaactcattgacgggattttggcaggccaggttgtttttctcagcgatgcatcaaggaaagcgaagctgttttccgtcgggcagaatccgctgcgttccattatggaacccgaatctgaaagtatcgtccgcggtgcccatgacgggtttgtggaaagtttggaaacgaacattcatcagctgcggtttcacatacaggaccgccatctctccgttcattatatggatatcggggaaagagccaaatcaaaggttgcggttatctttgttgagaatatcgccaatccggagattgtggaggaagtgaagcggcgcctgtcatacctgcgtatagacagcgtgcttgcgcccggaattatcgaggagtcgatagaagataattcgttttccatttttccgcagatcgttcatacggaacggccggataaagcaaaagcatgcgtgatggaaggctgtgtgctgatcatgatggatggcagcccgtcggccttgattgcgccgatcacgttcttttccttttttcaatcgccggatgactacagcacgaggtggatttccgccagttttttgagagtgctgagatttttcgcctttatgatcgcgattacactgcccgctttttatatcgcgctgattgcgtttcattttgaagtcattcccaacgatttgattatcaccatgaaaaattcgattgttgatattcccttccctccgctgatagaggccatgattatggagattacgattgagctgatccgcgaagccggtatcaggctgccgaaaccgatcagtcagacgatcggcattgtcggcggtctcgtgatcggtgacgcagtcgttcaggcgggactcatttctaatatgatgattatcgtcgtggccgttacggccgtttcttcttttgtgcttccttcatatgaaatgagcacgtccattcgaacgctcagatttccgcttatgtttctggcatcctcgttcggttttatcggcatcgcattcggcttcggacttattctgatgaacctgtgcaagcttgaatccctcggcgttccgtatttatcatctctgacgccgtttcatttcagtgacttaaaggatgcatttatccggctgccggcctggtttattaaaagaaggcctttttatttgagaccgcaagattcaaagcagataaaacatgttcgggggtggagaaaagatgaagcctaaaaaaatcagccggcttcaaggcgtgtttttcattaatcagacgcagatcagcatcggcattttggcgctgccccatttactgatgatgaaatcgggaagcagcggatggatttccattctgcttaccggattgctcgtccagcttaccttcagcctgtatatgatattatttcaccggtttccgaagctgaacctgtatgaaatgctggaggaggtgttcggaacacttgccggcaaaggggtgcaggtgctgtatattttatatttcgcgtttctctgcacgctcattctttctgtatttacacggttattggatatctgggtgctccctcagactccgaattgggtgatcagcttaatgctgatcctcggttctgtctatatcgcccaagccccgctgaatgcgatcgcaaggttcagctttattttaacgccgtttttgctgctgatctctctgccgcttttatacacactgggaaaagccgatatcacatacattatgccgatttttcacggaaccgcaaaagacatgcttaccggggtgcagcaaacacttgtcagcattaccggctttcaggcggcgcttgtgatcgggccccttatcaactgcaccgtcagccagcgctacaaaatactgacgatttcaaacggcttgattatcctttattacctgtatatcactcttacttgctttgtcaccatcagccccgaagaaataaaaatgatcccggagcctgtgctgtacctgttaaaaaccgtttcattcagaattatcgaacggacggatctgctctttttgacgttttggttcgtgaccgtcttttcaacgctggccaacgtgttttacttggcaagcaccggcatcgccaagctgttcaatcaaaaagatcacagccggtttgtttatccgccggccctgctcgtcttccttctgtctatttgggccacaagcacagataaaacgatacagcagctggatcagtttttccgcatttccgatattgtgtttgtgtatttgtttccgttgtttatggtattgattgtccttgtacgcaaaaagggtgtccgccatgcgcattaaaaaagcggttcttatcagtctcatgtgcgcaagcctgacacttgcgggctgctgggatcaaaatttgttgaaagatatttctctcgtgctgaccgcaagccttgatgttgatcatgacggtaaaaataaaatcggcattacctatcggaaggttcagtcctcccaggcggaacaggaaacgggcggctcattcattacgacggtgctcagcgcttccgggcacaccatccgtgaagcgcggtttcaattggataagcttgtcgaccagcgcattgacacgtccaagcaaagagtcttattaatcggtgagaaaatggcggaaaaaccgctttttccttatctcgatgtcttttacagagatccgaaaagtccgcttctcgctcatccggcggttgtaaaagacggcgaggcgattgaagtgctgaagctgatcgtccggcagaaattgatcgtcagcaagtatttaacgaatttattaacaagcgctaatgcggaatcaaatatcagcatggaaaatttgcaatccatccgttcaagcatgctgacggctgataaggatttcgcccttccttatttatcgattaacggacagacgataaaggtagagggttctgccctgttcagcggccagcggaaagtgactgaggtgctcggtcaggattcgaccctcctgacccttttaagcgggcaatttaataaatcggctaatattaatctgaagctgtgggacaaatacaaaatggatattgaaaattatctttctctcggcatcacggatgccacgcgaaagattgtatttatagatacagatccgcagcatataaaagtgaaaatccgtttaaagctgaacgcacgcgtcttggaatatccgaaggacaaactgaattcttatacggcaatcgaccaaatgaacaaacaagcatcagcaaatttgaacagccaggccagatcggtgatcagccatattcaggagcacaactcggatatcctcggcatcggccggaaatatcaaacccattattatgagcggggcaagcggctcaattggcgtgaggtctatccttctatcgagataatccctgatatcaaagtgaatatctcgcaaatcggcatcgtgaactaaaagagaccccggtctctttttttgttgccaaccgaaatgattcgtggtactctttctgtgtaaacggttacataaatgaagggggagtgtttgttggcaacgattaaagatgtcgcaggcgctgccggcgtctctgttgccacggtctcgcgtgtcctcaatgacaacggctacgtccatgaagatacacgaacgaaggtcatgcttgccatggagaagctgaattattatccgaatgaagttgcccgctctctttataaaagagaatccagactggtcgggcttttgcttccggatattacgaacccctttttcccgcagcttgcccgcggcgctgaagacgagctgcagcgggaaggataccggctgatcatcggcaacagcgatgaagaattggaaaaagaactagactacctgcaaacatttaaacaaaatcaagttgccggtattttggcggccacccattaccccgaccttcccgaatacagcggcagcctttccccggtcgtatttctggaccggacaaaagaaggcgccccatccgtattcagtgacgggcgggcaggcggaaaacgggcggctgaggaaatgcttcgcggcaaaagcacaagcatcacgcttgtcaaaggcccaggccaccttccgaccgctcaggaacgttttaacggcgcacttgatgtgctgtataaagcgggcgcgcagttcaatgtcatctccgccgcttcattttctatcaaggatgccgccgttttagcagaaaaattgtttgcagcataccccgaaaccgacggagtcattgccagcaacgatattgcggcggctgccgtcctccatgaggcgctgcggctcggcaaaaaagttccggaggagattcagatcatcggatacgacgatattccgcagagcaggcttttgtttccgccgctttcaaccatccgccagcctgcatatgagatgggaaaacaagcggcaaacctgctgctgcaattgataaagaaagagccgccgaaagagacggccattcaaatgcccgtgacttatataaaaagacaaacgacgagaaaggatgatcaccatgagtgaaatttgtgttatcggaagctgttctatggatctggtcgtcacatccgaacggcgtccgaaagccggagaaaccgtactgggcacagactttcaaaccgtgcccgggggaaaaggcgcaaaccaggccgtagccgcttcccgccttggcgcgaacgtatatatggtaggaaaagctggcagtgacagctacggaaaagcgattattgaaaacctgaaggcaaacggtgtcaatacggactatatggaaacggttacacataaaaaaagcggaacggctcatattgtgctcgcagaaggagacaacagcatcgtcgtcgtaaaaggcgcaaacgatgacatctcacccgattatgccaaaagtgcgctggcaaaacttcccggcattgatatcgtgctgatccagcaggagattcctgaagaaaccgttgaagaagtgtgcagctactgccgcgcgcaccaaattccggttatcctgaatcccgcgccggcccgcccgctgaaacaatcgacgattgagaatgccgcatatcttacgccgaacgaacatgaagcatccattttatttcctgaccggacgaaagaagaagcgctcgccggctatcccggcaaactgttcattaccgaaggaaaacaaggcgtacgctactcagacggcaccgcggaacggcttgttcccggcttccctgcagaagcggtcgacacgacgggtgccggcgatacctttaatgcggcacttgccgtcgcgctcgcggaaggacgggacatcgagcaagcgctcctgttcgccaaccgcgccgcctccctgtccgtgcagcacttcggcgcccaaggcgggatgccggtcagaaaagaagttgaggagctgctgtcatgaaaaaacacggaatgttaaacagccacattgccaaagtattagccgatctcgggcatacagacctcatcgcgatcgccgatgcgggtctccccgtccctgacggcgtccctaaaattgatttgtccttaacggcgggcattcccgcctttcgggacgtgaccagcctggtagccggagagatggccgtcgaaaaggtgatggccgcctccgagatcaaagacgaaaatcctgagaatgcaagtttcatagaaagccatttctcagcgcagacgatcgagtacatgccccacacggaattcaaacggctcacacagaaagcaaaagccgtcatccggacgggtgaaatgacaccatacgccaactgcatcctgcaggcgggtgtgattttctagaaagaagggatccagcatgcacatcggcatgacagacattcataaagcattcggcaaaaaccaagtgctatccggcgtctcatttgagcttctgccgggagaaatccacgctttaatgggagaaaacggagcgggcaaatcgacgttaatgaatctgctcaccgggctctaccggctcgacaagggaaacattacgataaacggaacaaatatgaatttctccaatccaaaggaagccgaaaagcacggaatcgcctttatccatcaggaactgaatatatggccggacatgacggtgcttgaaaatctttttatcggcaaagagctgacgacggcgttcggcgttttggaaacgaagaaaatgaaagcgctagcaaaatcacagcttgaaaaactgggagtctctcttcctcttgaccgggaagccggacaatgttccgtcggccagcagcaaatgattgagattgccaaagcgctgatgacaaacgctgaagtcattattatggacgaaccgaccgcggcgctgaccgaacgggaaatcagcaaactgtttgacgtgatgacggcgttaaaacgggacggcgtatccattgtctatatttcgcaccgaatggaagagatattttcaatttgcgaccggatcaccattatgcgggacggcctcactgtcgatacggcgcatatgaaagatactcattttgatgaagtggtcaaaaaaatggtcgggcgggagctgaccgatcggtatccgacccgcacgccgtcactcggcgataaggtgctcgaagtgaaaaatgtctcaaaaaaaggaagcttttcacagatcagtttccatgtgagcgccggagaaatcctcggcgtttccggcttaatgggtgccggacggacagaaatcatgagggcgctgttcggaattgaccggctcaattccggagaggtctggatttccggccgaaaaaccggcattcggggtccgtacgatgccatccgcaagggactcggcctgattacggagaaccgcaaagatgaagggctgctgctggatacgtccattcgtgaaaatatctcattgccgaacctgaccagtttctctccgaaaggcatcattgaccgaaaacgcgaggcggagttcgttgagctgctcatcaagcgtctgaccattaagactgcatctccggaaaccgccgcccggcatttatcaggaggaaatcagcaaaaagtcgtcatcgccaaatggatcggaatcggcccgaaagttctcatccttgatgaaccgacaagaggcgtcgacgtaggcgcgaaaagggaaatctattcattaatgaatgaactgaccgatcgcggagtcgccatcatcatggtttcttccgagctgccggaaattctcggcatgagtgacagaattatcgtcgtccacgaagggcgcatcagcggagaaatcaatgcggcagatgcaacacaagaacacatcatgacacttgccacgggagggcagcagtatgaaaactgaaccaataacatcaactgaacaaaagcgattttccattcataccttcacgcaaaaactcggtccgtttctcggcttactgattcttgtgctgatcgtttccgttttaaacccgagttttcttgaacctctcaatattctcaatcttcttcggcaggttgcgattaacgctctgattgcattcggaatgacgtttgtcattttaacgggaggcattgatctctctgtcggagccatcctcgccttatcgagcgcattggtcgcaggtatgatggtctcaggcatcgacccgatcttagccgtcatcatcggctgcgtgatcggtgccgtactcggcatgataaacggattattaatcacaaaaggaaaaatggcgccgttcatcgccactttggcgacaatgaccgtctttcgcggactgaccctcgtctatacggacggaaatccgattacggggctcggttcaaattacgcatttcaattattcgggcgcggttattttctcggcatccccgtacctgccattacgatgctgattgcatttgcggccctgtgggttcttctgcacaaaacaccgttcggccgccggacatacgccatcggcggcaatgagaaagcggcgctgatatcgggaatcaaagtgccccgcatcaagatcatgatctattctctgacaggtttattatcggcgctggcgggagcgattctgacatcacgcttaaattccgcacagccgacggccggagaatcatacgagctggacgccatcgcagcggtcgttctcggcggaacgagcctgtccggcggtcgagggcgcatcatcggtacgctgatcggggttttgattatcggtacgctgaacaacggcttgaaccttctcggcgtatcatcgttttatcagctcgtcgtcaaaggaatcgtcattttaatcgcggtgctgctggaccgcaaaaaatcggcatagtaggaggaccattatgaagaaagccatcatcacgatcgcggcattatcactgtttttgctgtccgcctgttcacttgaaccgccgcaatgggcaaaaccgtcaaacacaaaacataaaaaagaattcactatcgggctctccgtctccacattaaacaatccgttcttcgtttcattaaaagaaggcgttgtaaaggaagccaaaaaacggggcatgaaggtcattattgtcgatgcccaaaatgattcatctaaacagtcaaatgacgtagaagatttgatccagcagggagtcgatgcgctgctgatcaatccgaccgattcatcagcgatttcaacagccgtcgaatcggcaaattccctcggcattcccgtcattgcgctggatcgttcagccgaacacggcaaagtcgaaacgcttgtcgcctctgacaatgtcaaaggaggagaaatggcggctgactacctcgccgatcagctcggaaaaggcgccaaagtggctgaattgcaaggggtgccgggcgcatccgcgacacgggaacgcggaacgggctttcatcatattgccgacaaaaagctggatgtcgtaacgaagcaagcggcagattttgaccgtacaaaaggattgaccgtcatggaaaacctgctgcagggacatccggatatcaaagccgtgttcgcccataatgatgaaatggcactcggggcgctcgaagcgattaacagctcgggcaaacacattttggtcgtcggtttcgacggaaataaagatgcgatttcttccattaataatgggaagctgacagccacggtcgcccagcagccggagctgatcggaaaactggcggccgaagcggcggagcaggtgctcaaaggaaaaaaagtcaaaaaaaccatttccgctccattgaaacttcaaacgcaaaaataaccggccgatgtttagacttccggtaaaacgtgaaaggatgaagtaaaaggagagatacagatgaagaaaacagccaaagcggcatccatcctgacccttgcagcgggaatatcagcggcttcagctgccggaataacgcctcttcccgagacacacgcgcaagaagcggtcaaaattgacgatctgtacagctacccgcttgactcttatcttgtttccgcggaagcattgaacgtgagaacaaaagcatcagcagccagtccgagagctgatacccttcatttaggcgacagcttaaagatcgtttcattccagaacgctgactgggcaaaagtacattataaaaacggaaaaacaggatttgtatctactcattatattgttaaagaagcaacaaccgtaaaaacgacggcaaaaacaaaagtatatacagacaaacaagcggtcaaagcttcccttgccaaaaacacgagcgtttctttcctcggatggaaaaagacagccggcggcggcattgatttcggctgggcgcttgtcgattacgggggcgcaacgggatatatcagcacaaaagatctgcaaaaactgacataatatcaaaacggatttcgcaaattcagcgcgaaatccgttttttctttcttgagcagtcagaaacgtctaaggttcgaaatatttctcaggaaatattgtcggatgaagatgaatgcatacgactctaaaatggcttctttatgtaatccgccaggcgtttggcgttgtcacggatagccgcagcatcggcgctgctaaccccgtacatcgcgaaagccggcaaataggtcattcccgtaaaattagccattgcctgaaacggccttaagagctcgctcagtgaaaaatggttggacccgcctgcctgatatgcatcctctccggcacctacagaaacagccagcagcaattctttgccgtgcagcgcctttcctttggaaccgtaagcccagccatacgccagcacatgatccatccatgtttttaaaagcggaggcgcactgtaccagtacagcgggaattgaaatacgatccggtcatactgttcacacagctgccgttccttttccccatctattttcccgtccggatattctttataaagctcacggaccgtgatgtcatcatgattttttaattcttctgtccacgccttattgaccgctgagttgtccatgtcaggatgaaccgctaataccaatactttcacagctaccacacctttcccttttgactgtattttacctaatctttgccggttcagccaaataaaaagaaagcccccgagaaaaatgaggctttcttttttattttattccggacttccttcggttgtttcaatatccttcgcaaaattcggattatctaaatttgcgttgaaaaagtccgccgtattcggaagcttgaggttcatattcattttttgagaaatggtcactttacaatctttaatgacatagtcaaacacgtgtcccccggaattgcgtccttcatcaatgaagtgcaggtgatatccggaaacagcgatgccgtttgcgtaacccggcgtccagaagccggcgattgtaccctgaatatcgtcaaagttgaacacaggctgtgttttcaccgcttcaatcatcggaacgtacggtttctcctggcgttctaccgttcttgtctgcacctttttaaatacgccgtctaaacggatcgcataaaataagtttttactaggcagaaggctggcgatttcctgctcgaattcttcacgggtcatttcgccgtcgatcgtatgcgtcatgtccggcgtgaaaaatgtgaatgagcagaatggtgacaggtctccgcctttaacaggcgtagccgttccgtcgccgcgcagacggtaaaattcgccgtcaaatccgattaattcgccgtccagtttattgaacgtgccgatcccgaaatcaccgaacttcggaatgtcagccatatcaaaatctccgtcatacactccgtccagcagagatgtcatggtggatacttgatagatttgatcctcaggtgagcctttttctccgcggctcatcatatggatgtcgcttgcatttttcatattcccttcactccttttaaattgggctgttttagaaaacaggtcatggtgcgcagagtgctagagagcttttgctttcattttttctttgaattgcttcggaagcatgtcgcttgataaatggacattgtcactgtaatcgacaggaatgtcaatgatgacagggccttctgtgttcaagcctttttgcagcacgtctgccagctgttccggtgactcaacgcgcaagccggtggcgccgaagctttctgcatattttacgatgtcaatgtttccgaaatctacgcatgatgtacggttatattttttcatttgctggaatgcgaccatatcatatgtgctgtcattccatacaaggtgaacgatcggcgcttttaagcggactgccgtttccaattccattgcagagaacaggaatcctccgtctcctgaaacggatacgactttttcacccggattcaccaatgtggcggcaatcgcccaaggaagcgctacgcccaatgtctgcatgccgttgctgatcaacagcttcagcggctcataagcgcggaagtagcgggacatccagatcgcgtgagaaccgatatcgcaagtgacggttacgtcgtcatcaattgcattgcggagttcttggacgatttgcagaggatgcactctgtcggatttatgatcgcttggcgccttctcgctgtctgtgagcatctgttttaactcgctcagcacttctttttcacggctgcccatatcaaatgtcacagcgtcgtgttcaatttgtttaaccgtagcggggatatcgcctaataattctaattccggctgataggcatgatcgatatcggcctggatttcgtcaagatggataatagcacggtcaccgtttacgttccagaacttcggatcgtattcaatcggatcataaccgatcgttaatacgacatctgcctgttcaagcagaagatcgcccggctggttgcggaacagtccgatccggccgaaatattggtcttccagctctctggacaatgtgccggccccttggtacgtttctacgaaaggcagttttgttttggcaagcagtttgcggatttgttttaccgcttccggtcttccgcctttcatgccgactaacagaacgggaagtttcgccgtctggattttcgcgatagccgcgctgaccgcctcttccggtgcagggccttgtttcggcgccggcacgctgcgtacgtttttcacatttgtgatttcattcacaacatcctgcggaaagctcacaaaagccgcgcctgcctgacctgctgacgctgccctgaaggcgtttgttaccgcttctggtatattccctgtttcctgtacttctacactgtattttgtaatcggctgaaatagcgccgcattgtccaatgattggtgtgtccgttttaaccggtctgcgcgaattacgttacccgccagcgccactaccggatcaccttctgtattagccgttaacaagccggtcgccaagttggatgcccccgggcctgaagtaacgagacaaacgcctggttttccagtcagtcttccgacagccgcagccataaatgcagcgttctgttcgtgacggcataaaaccagttcaggtcctttatcttttaacgcatcaaatactgcatcaatttttgcacccggaatgccaaaaacatgtgtgacaccttgctccactaagcaatcaacaacaagctccgccccccgatttttttcagaggtttttagttcatttgttgcttttgccaacaccctcactccttattatgcatattaaatataaaattttaagtaatttgtgatattattcactatacactctttggaaattgacctccaatatcaattcgccgtatgattaatatgtttcacgaataattaacaaagagaaaggaatggataaggatggagcttcgccatcttcaatactttattgccgttgccgaagaacttcatttcggcaaagcggcgcttcggttaaatatgacacagccgcctctcagccagcagatcaaacagcttgagaaggaagtcggcgtgaccttattaaagcgcacgaaacgggttgtagagctttcagctgccggagaaagttttttaaaacacagcagaaacgcgatcgaagaaatagacaaagcgattgaaatggcgcagagaacggcgcggggagagctcggccgccttgtcgtcggttttgtcggctcggccacatatgaatttctgccgccgatcattcgggaattccgcgaaaaattcccctccgtcaagcttgatctgcgtgaaatttcttctttcagacagcaggaagaacttctgaaggggaacattgatatcggcatccttcatccgcctttacagcattccgcgttacatatggaaaaggtgcagagcagcccgtgcattctggctttgccgaagcagcacccgcttaccgctaaacagacaatcgacattcaggatttaaaaaatgaaccgattatcacactgtcgaaagaaacatggccgactttatacctggagtttgtaaactactgcgagcaggcgggcttcaaaccgaaaatcgttcaggaagcgacggagtatcaaatggtgatcggattggttagtgccggtatcggtgtaaccttcgtgccttcttctgctaaaaagctgtttaatctcgaagtcgcctaccgcggcattaatcaggcgcagctcactgccgaatgggtcattgcctaccgcaaggataatcaaaatccgatcctgaaacattttctggatattatgaataagcgccaggctttattgcaggcggataaggaaaatgcataaaaaagagggccgccgaaagcagcctcttttttttgtgcttttatggatttttactaaattggtagaaacgctcagtacaccttacgacctgtacccgtatacatacagtacaactgatcaggagggataaaaataacggggcggcaatgacccatcgaaaaggaggcagaacacattacacatattaccgtcattttgaccctgatttctttctttgtgaccattatttttatattttggagacccgggggattaaatgaagccgttccggcgtcgctgggcgccattctcgttttgttatgcggaaccgtttcctttcatgatttgggggatatagggtcaaaagtcaccggagcatcaataaccattatctccacaatgataatggcgatcgcgctggaaagcttcggtttttttaactgggcggcggccaaactgcttcaccgcgccaagggatcaggcatccggcttttttggctgaccaacctgctctgtttttcaatgacgctctttctgaataatgacggcagcgtcttaatcaccactcctattttactattggtcttacaatatctcggacttaaaagacatcagaaaacaccgtatttaataagcggcgtattaattgcgacggcggcaagcaccccgatcggcgtcagtaatatcgtcaatttaatttctctcaaaatgataggcatggacctttatttgtacaccaatatgatgtttatccccggcacgctgggactggtgtttatggcctttctgctgtttgccgttttctaccgccgtttgccgaaacagctccccgatattccggttcaatttgaatcgctggaacacaaacgatatcatccgcttcagcctcagccagacttgtcccaaaaaaacagccgtacgaacatcatgttttgtgttttggtatttgtattgtttgtccggatcagtctgtttgcagcttcttacaacggcatatccgtttcgctcgtggctgtcatcagttcagtcatcctgctttgctggagatggttttatttaaaaatcggaccggcggacttattaaggaaagcgccttggcatatctttatttttgccttcacgatgtacattatcatttacggactgcataatatcggactgacggcattgcttgttcagtctattgagccttatgtctcacaaagcattgcccacgctgcatctattatgggcattgctacatccgtcctctctaatttgttcaataaccatcccgccttaatgatcagcactttgacattaactgaaatgtccatcgacccattaaccgtaaaaatcatttatctggctaatattatcggcagtgatatcggatcattgcttctgccgatcgggacattagccacactgatctggatgcatatcatcagacagcacggcgaaaaagtttcttggtcagaatatatcaaaacgaccattgtcgttgtccctctcaccgtcgtgtttaccattaccgttttatatgtttggatcagctggatttacctttagctatgaaaaaaactgcctgctgtataagagaggcagttttatcatttatggcaggtgcatggtttttaaatgattcaatttccaaaagacagtatccccgtctgcattggtcaattcaagaatattatctgagacgtcctgtaacagccccactttattcggtatatctcctaaatccagaataatcagcttcccgacatatctttttaattgctcctcaaaattccggacaaggggcacattagcgggaacaaccggcagctctgaactgtttaatgtatacggcgtctgctcatcggaatagggtgtcagccatttcaaatgatgcatcgagatgaaaagagtcttataaaccggagagaagaaaacaaaataatcatttaaaacacttgtcacatacccatgaatggaacggtctcccgtaacgaaaatttctgtaaatctgccttttatatgctggagggtattccggtaagaaaaggaatgttcctgtttttcgggatgcggacttttttttcttgcgtacggttctttattctcttcgtccgggagcgtcaatgtcatcctctgaagatgcagcagcgtaatataaagaaacgtccggccgtcatgaatcacaatgatatcctgaccgatatccaaaagagttcctgaaaatgtcgtattccccgatatctcaatatcgacttgtttatccagaaatctgcttaatccagccatttcattccccctctcccgcgtttacggacaatctttccaatcatttacggccgtgtttccacctataatctattgtccttaatacagtggcgtagctataagagttctcttcctcccgttttgaggatcgaacggatcttgacgatcttttcgactttttagaggaagtacgctgctcttcgcgagattcttcttcatgtgacttttcttcttcggcgctctctttcccgcctttattctcgtcgtctttattctcctcttttttggctgctccttttgccccttcgctgatgctcttgatatgaaaaggatagatccgcagcacttctttatctttcacaagagtgtagtggccgtcggaattatccacaagtataccttcaacggcttcaggacctccgcggttgatggatacccatttgtggatcaggcgtttaaatatgccgtgaaaatcatcagccatttcaaattccgggcgctcctcctcctggccgtcctcttcttgttccgcgctgatgcttttgacatgatcggcgttaaaatatacgattccgtcatcttctgtttccagcacgagaaaatcatcccctgtttcgtgaagctttcctcttttcgattccggacctccctgattcaattgcaccgtgcgattggtcatccggctgatcagatcttgaaaatcatcagctttttcacattctgccgcttcggccggcgatacggtttcactcgtattttccgtcacactcttcacgtgtttccattgataataaacgattttattatcaacttgaagagcgatataatccgattgaatgtctgctaatctccctgtcttggactccgggcctccccggtagacagtaattacttttccttccatcgcatgcaaaaagttgtcatcagaccgatgccgcttcgtattgcgtttcatctattgtcctcctagtcatttttctcataatgtaaaaagcataatgcatatatacgtatcacgattattttcgggaactgattcaccagcctatttgtaaaaaatctttcttcatttccaaatcagatattccaccgctctaactcactgctgatgaaggcggaccgctccttaatgtattcgcaaatcacatcaggctcccggtcaaagcaatcaatctcctctttcttataaggatcctttgcgacatgcggcctgatctgctcatacagtgacatgaccttcggcttcatatgttcaatggtaaaccgggtctgaagcgtttcttccaaaagctgtttgtacgctttgcggaaatacggttcatccagaagccttgcagtcaaggtattaaacccttgtattctgacataatcggcgtccatccgatcaccgtgaatgtctcttccccacgtcgcatcgtaatcccacggaatgacttcaaaaagtcccgtttcatgattccggtacaaagcgtaattatgaacaaatccatcgtagtttgaggtaaacacgatgcccgcaagccaccgcaaatacttatcggcgtccaagtgtttgacgatctcccccttgaactctgacttcggcacggtattaattttatagatcatgtcctgcaagtataaatcgtcttctttcgttcccgttttcttttcataaccaagttcgagcgatgttttcgtatcccgctccagatcactgacgagggagaaattggcgtcgtcatcaaccgcgtaaaaaacagccccgtccgccaaattccgtttcgccagaaaatattcatccactgactccagctcaagatacaccccctcatgtctgccattgatttgcagggttacgaaattcgcctttggtgacagcgtcccaagctccgcgaagaaatcgagagacagcttattccgcatcatcgacggatctttgtattcagcgtttaaatgtatctctttcgccctgcgaaatgttttcggcgaataaaaagcgatgtgatacgattttttcttaaaatctcttatatgagagccgcggtacgccagatcaatgtcaagccgtttttgattcactctcagcaccgcgggcaccggatcatcatcccaaatgtcttttttcagctccattaagtctttcgggtgaataaacagctggtatagaggcaatgttgattggtctttcatcagtaaccctccctgtattaatttaggctgtgctatttatataaaactcagcgaatcacacatacacttttttcattcatgcgtactatgtggtagtaaggatcgcatccttaaaacatatatcatgaggaggtttcaaaatgggccactattcccattctgatatcgaagaagcagtaaagtccgcaagcaccgagggattggaagattatttgtaccaagaaccaaaaagcagtaagaagagaaaatctcgcagccataaaaaatcccgttctcacaaaaaatctcgcagtcataaaaaatcgtgccgctctcacaaaaaatctcgcagtcataaaaaatcgtgccgctctcacaaaaaatctcgcagccataaaaaatcgtgccgctctcacaaaaaatctcgcagccataaaaaatcgtgccgctctcacaaaaaatctcgcagccataaaaaatcccgttctcacaaaaaatctcgcagtcataaaaaatcccgttctcacaaaaaatctcgcagccataaaaaatcgcgacgctctcacaaaaaatctcgcagccgtaaaaaatcttgccgttctcacaaaaaatctcgcagccacaaaaaatcatgccgccgcaagaaaaaacgcacgcagaaaaaaccttaccgtcctcataaaaaagacccttgcaaaaaagacgattactgcagcaaaacagagtactggaaagacgggaacatctgggttgtaaagaaaaactacaagtaacgccatttgtaaataggctgccggctaaacggaagcctttttcctcaatcagatatatgccacgtgataagatatgcagccggttttcttttgttgtgtttccgaattttctttctgtataatcaggtcatacgataaagaaaggcggccgaaatcatgcatatcttacgagcagacgaactgaacgcaaaagacacctacaaattgctttcgggcacagtcgttccccggccgatcgcatttgtcacgacgcggtcatccatcaacggcgccgtaaacgcggcgcccttcagtttctataacgttgtctccgcagaaccgccgcttctggccatctctgtcagccgcgcggacggacggcagaaagacaccgcgagaaacgcaatcgctcatcgggaattcgtggtgcacgtcagtgatgagtccattattgaagacattaacaaaacggcggcaaggcttgatcctgatgtcagtgaacttggcatgacagacctttctgtgacagacagcgcctgcatcagcgttcccggtataaaagaagcaaaagtcaggtttgaatgtatactcgaacgccatcttccgtttcaaaatgacagcggagaaacgacgacagacctcatcatcggcagagtcgtttgttttcatttgaatgaccaagtatatgacgccgataaaggctacatacggacagatgagctgaagcctgcggcaaggctcgcggggaatgaatacgtcagactcgggaagacatatacgcttgtccgcccgacctgaagcaggaaccattataatagaagaaactagtcaaaaagacccctttcgaaaggggtcttttttgagtcttttaccattaaactcagcctaatgtcttatagaatgctgaaacttacaaggccctcacccatatgaaacgagtgacatttttaggaggagacgatggatttcattcagttactgattttttcagccgtatttattttgctcagccttatgtttcaagtatttgccgtcaaagttcttcattttccaaaggctgttaaaaagcagaagccgataaacggcacacatcgattaatcgaaatcacactgcttattacgggcatcgcagcggtgactttgttcaatgaaatgtacgtatttgcgggagttgttttcatgctattttgctgcagcggcttaatggaatggcggcaccggcgggaggaaaagcaatatgtgtacgattcgttttacgcaggtctttctgccgctcttggcgtgcttatttttttcatcagttagcgtatcatgctctatactcctgcggccgctccgtcgccgcgcgggtcggccccgccttggagaaagccttcttcatcaatgacgatcgctgccgcatggcccataagcccgtcaaaatcaccaacggtctcgacgcggtggccgctctgccttaaggcttctctcgtttcagggctgattctgctttcaaccctcagcccttcatactcctctccccatgtccgcccccagacccagcgcggctcattgatcgcctgctgcgggtccattttgtaatcaatgatgcgcgtaatcatcgctgtctgagtttgcggctggccttctcctccctgggttccgtacaggatgtgcggctttccttctttacaggccatcgccggcatgagggtgtggaacgtccgcttgccgggttcaagtgtattgacatgggattcatccagcgaaaaaaatgacccgcggttttgcagcagaatgcccgtctcccccgccgtaacggctgacccgaattcaaaataaaggctctgtataaaggaaacggcatttccttccgcatctctgacggcggcataagcagtgtcgcttccgaccggacggcttagcgccggcgcagccgtgtcaccgatttcttccgccagctgctttgcataccgtttatcaagcagccgatccagcggaatatgagaaaatgccggatcagtcagcacttcattccggtgctgaaaactcttcttcagcgcctcgatcagcagatgataatagtcaaaggagccgtgttcaatctgagaaaaatcatagttttccaatatattgagcgtcattaagcctgtaaagccctgtgaattcggcggagcctgatagatgcggtatccgcggtaatcagaggataccgggttcgtccactcgccgcggtgggctttaaagtcatcaagtgtcagacggctgccgttgttttgcagaaaggatgtgatgctttgagcgagatctccttcataaaaagcgcttctgcctttctcggcaagctgttccaagctggccgccagattcttctggacaaaccgttcaccgggcatgggcgcttttttgtttctcgtaaaaatggccgaggtgtaaggcatcgaggctaaaagagcgagattgcgttctgtgtgggcgcactggtcggcggacaccgggaatccgtttgccgcataatcaagagcaggcttcagcacctcagcgagcgaaagacgcccgtacgccgaaagcacggcatcccagctgtccgccattcccggaacggtaatggcgctttctggcccgcgcagagggatcgcttctctgccccgatacaagtctctcgtcacatgcttccctgaacggccgctcccgttataagctttgattcgtcccgtttctttatggtaagtgagccaaaatgaatccccgccaagacccgtcatatgcggatacacgactgccaggcaggcgctgaccgccactgccgcgtcaaacgcgtttccgcccttttccagaatgccagcccccgcctgagaagcaagataatgcggactgacgaccatttgtttcgttccgatggttgaagtattcatggcaagcccctttacaaattttcctaagtataaaaagcggcttcaccggtatccactttcctgaaagaaaagctcacacactatttactttccgataagaaataatcctaagttattacgtaacgaaaacaataaaaaaatttctccttcataccgtaacatttcatgatacaataatatccaccaaatgaaggaaggtgaagccggttggaacatgagtacagcattccgaatcttgtccttgatgaaacggataaacagattctctcaattttgcacgaggaagggaggatttcctatacagacttaggaaagcgggttaacctgtcgcgagtggcggttcagcaccgcattcagcatttactggatgccggtgtgattgaaaaattcaccgctgtcatcaacccggcgaaaatcggccgtcatgtgtccgtgttttttaacgtggaggtggagccgcagtatttggaggaaaccgcattaaagcttgaaaaggagccggcggtgacaagcctttatcatatgaccggaccgagcaagctgcatatgcacggcattttcgcaaatgatcaggagatggaagagtttttgacaaaacggctctatacgcaaaaaggcgtcgtcagcgtcgactgccaaatgctgattaaacgctataaaagcagaacgggcatgaagctgtaaggaggacatagccatgaaacatccctattgggacattacggcggcgatggtccgaacgggcattctcggattcggaggcggcccgtcggtgatcccgctcatccgccatgaagccgtcaataaatacaaatggatagatgatgatgaattcggagaaatattagcgatcgctaatgcgcttcccggaccgattgccacaaaaatggcggcgtatctgggcttcaagctgaaaggcacgttaggcgcaatcgcggcaaccctcgcacatattctgcctacatgtctcgctatggcgggcttgtttgcggctgtcaatgtcttaagccgctcagcaatcgttgccggcatgattggcgccgtaacaccggtgatcgccgtcatgctcggcatcatggcgtacgagtttggccaaaaagcgcttaaaggtttcggctgggtcacgggcatcctgttttttatcatcgcttttatcggcctgcaaacgttacagatcaatcccggctttgtcattatcattttcttggcatacggcgcgtttcattttaaattaaaggacaaaatcacaaagaaacgttcaaaagataaaggaatgccggcctcatgatcttgatttatgtatttatggcgttttttgtcgcaaacgtactcggatatggaggcggaccggcgtcgatcccgctgatgtttgaagaagtcgtcaacagatacaactggctctcaaacgatcaattctcaaatatgctcgcacttgcgaacgcattgccgggcccgatcgcaaccaaaatcgcggcgtatgtcggctacagcgcaggcggatggcccggattcctgattgcgctgatcgccaccgtcgtaccgtcggcgctcgcattgatcatcctcttgcgcgtcattcagcgcttccgccaatcccccgtcatcaaaggtatgacgctgtccgtccagcctgtcatcgccgtcatgatgctcattcttacctggcaaatcggcgcagacggcatcaaagcgatcggctgggttcaagcgataatgattgcggggatttccctccttgccttgacaaaattcaagatgcatccggcctttctgattatcgcggcgtttttgtatggagggcttgtgattcctcatttataaagaaaagcacctggacaggtgcttttttattttggccccacaatgccgtttgatatgacaacagattcatcgcctgcatcactcttgatgatttgcttgacttgcagcgttgcgcctgccattctcacaaattgctgaacctgaggcgaattggtttcagcctgtatccaaacagaagtcggcgctttccaagctagaaagagtgcaagaatcaacataccagagataaccagcagcagcttcatatcgcatcactccttttcaataaacggctcgcagcggacagcgcctgttgatcatgaagaatatcaccgggacgattgccttctcccaacacatagcctttaaaggacatccccataaaatcaaaaatatgttcaaattgctgaatcagcggcagcccttttagtttagggttgtctccgcccactgctgttacatatgcctgcttcgctgacatttgctgtttaaaatcaggaaacctcggatctctcagcgtctgtgaccagcgatcaataaacagctttaatgtccctgacatgccaaaccaataaattggggtggcgaatacaagaatatcgcacggtaatatcagctcaatgatagaatcgtagtcatcttgaacaggacgaaagccgccttgggcgtgacgcagatcttcaattggccggatccgatatttccgcaaatgaatgtgctccgcatcgaatccttgaacagccttctccgcaagaatatccgtatttccgccaggcctcgttccgccatgaataaccgcaatgttcatgatgcatctgctcctttgtttacgaatgattttcttcatcatataatggattcatcaatcaatacagataattatttcgattgtttcaatcgataaaaccgatttagaaagggcgagatcaaatggaattgaagcagctgatcacctttattaccgcagcagaacatgtaaacttcaccctaaccgccaagatgcttaactacgcacaatcaagcgttacctctcagatcaaatcactggaagaagaaatcgggactcctttatttgaacggctgggcaagcggcttttcctgacagaagccggcaaaacgttcaaatcctatgcggagaagatcattgcgttaacagaagaagcaaaaatggccgcaaatcaagcaagagaaacaaccggaaccttgaaaatcggcgcgacggaaagccagtgcacataccgccttccgcctatcataaaagaattcaaacaggcttttcctcaagtaaagcttatattcaaaccgtatatttccaacgaacaagcgaaagaacagctcttgcagggccagcttgatatcactttcattttggatgtgaatcggtcggaagacgcactgcacgttgaatctctgattcaggatgaaatcaaaatggtagccgccaatgaccatccttttccagcagactcaccagcaacattgaaggatcttcaaaatgaaacccttctgctgacagaggacggctgttcatatcgcacgctctttgagaacactttacatgacgccggagtctaccctaataaattagaattcgtcagcatagaagccatcaaacaatgcgtgatggccggactcggaatcggactattgcctgaaatgacagtaaaagacgatattgccgaaggacggatgaaagaactcaactggcagaatgaatgccccgtttttactcaactagcatggcataaggacaagtggatgtctgcgccattaaaggcatttatcgatttgacgcgaaaaacattcaaataaaaacctgctgcaaggacgacaaagtttttaataaagcagacaccaggcatacaaaaaaacacttggtggcttaaagctccaagtgttacatgtgatttttccgataaaacgttcgcaaaacatgcgtttcaaggtcagccagacggacagggatcggcagcctgcttctccttgtattccacattgttaaattattataaaaaaacttgccgataacaacacggcaagctcttaactatagcaattctaatacatcagtaaacaaggcatctcctaatgttaatctcctgttgaaaggctgtatatgtggcaattcactccactcatacacagtatcgtagtaatcatacaaataactgagttcgataaaccctttctcttgcattattttattaatatagttcgttccctgaatgaattctaaagattcagcggttcctacaatgtcataagcgccatctattaaatcgtgtcttagggaataactataatctaatacataaacaggaaccaatttagatactttcatattgatttgctgttctaaatgaaaaccattttccccagaaagatcttgcaaatggatatcaatttctcctgaaggattgtttaaatctctaacttcaatttttttcaaaccttttatttgattaaattcatcaggtacttttattttctctgcgcatttgctcttgtaccattcgtctaattccctattcacaaatagacgatgaagcaattcaccgatttcagggtattcattaataaatctgattccatgttccatagttttaaccatcccatcttcttgaaggctcgccttttttcgtctgcttaccagttacaggatcaaactctcctaaatgctctgttcttctgcggttccacttttctaatttaccatgctgggaatcccattgccaattaaacccatctctatctgaccaagattttctttttaatctttcttttatttgtatcatacctctttcttccatccagttagttggttcttttaaacgatatccatttgaattgtctccaactatcttctctctatcagctagcgcagcatagtattcttcagtccgtttctttttactgtagttagtaccattatgagcaacataatcattttgagtcatcccctcaggtttttccaaccattttggtttttttgactggctactagccatcttcacaatcccaagatccttcacagccgtcttttccacatcgacacggactgttgggaatccgtacgtaaagccgttcgctgttactgggcgttctgcgtacacgcggacgtttgtcgggactttgaattgtttaactttttctagtgtcttgttagctttttgaacttttgaatgggttgcaagcggtatgcctttgtttacatgcttcgccaatgcgccggcaccaaccaaactcagcgcagcttccaacgccccttgcttccgtttttcctcagacactttgtttccgaacatatcccgtcctgtgacggcttctgagaatccgtttgaggcgacaagaccgtatgcgcccatttctgtcattttgagaatgtctaaggattttccggttttataggcatctaaagcatgttctgcggcaatgacggtttttccggttttgtaaatggcttttccgcctttgaaagcgcggcccgcccagccgacgaccggtatgaatccggcggcggccatcgctcctgctgtgacgcgttctgcggtggagagtttttcgccggtcaccggatcaacgccttcggctgctcttttataatcataatagccggtgacttcgccggtaaagttgcagatgccgtcccatgttttttcgtaccatggtttattggcttcttcttcagccttttcctgaagccgtcttgcttcggcctgctgggcttttgcgtcaatatagtccgtgccctgtttttctgtcgccatgacgcttttgtagatttcattgctgtggaaggcttttttgtcatagtacataggggaggcgcttttcccgttgctggtggcctgcatgagaagggaatatttgctgagcactgcgttgtccagagattctaagttttgatattcagcggtcagggattcatcaagcgtatcgactgccgtgatcgtgtcgcgtctggttttctgggcatcacccattttatctgcgtaatcatccagcgtatatgtatcgagatgaataatatcactgatgccagacaaaatcgaatcgatttctgctttatgagcggagacaatctctgaagctctcaaatccgcattgggcagctcatgctctaaaaatgaagtctccgcatatgaatcactgagctcttgatctttaatgtcacctgaaatgccatttaaaaacgcaatttgagcagagacaagcgtcagccagctgtcggcgatttccgcttgtccctgaaagaaatcctttatattgtctgcgcctttccctttcaaagcatcacccagatcggccacgccttgaaaggcttgtttgagcgcacgcagctgttcttcaagggcttcgtattgtttctttctcttatctgcttcgtccgttaacgattgtgattcaaacactttgctcatcggcaagtcctttctttcgttattttacagcgatcgcctcgtcctgttccttcaaagaatctacgttgtctttaacgtccgcgatgttcttatgaacggcctgcttgtattcgctgatcatcgatacaagctttgcctcgcgggattggtatttggaggtatagtcgagcttgttttttccgtttgaaccggcgttcccgatagaaacggcctccaaagcgctgctgacggattcaagctgcttcatgacggctccgtatttgagttttatttctgccattaaaaccaactccagctttttttgattgattgtattttttctccgaccgtgtcaagggcttcttctcccagcgtcagcaggtgctctgcctctctcgcgatgcttctggcggcaaggagccctcctttttcaatttcaagctgtgtcatctttaagccgattctgtaaatataaccgtcgtatttgtctgtgacgattctgtatgcttctgtatgggcctgatcgcgccggtcatcaaattcttcagcaaaagtgccggtccaatgatgatccaggtgcggcctgaggatgtccctgatttcagacacgccctcttcctgcagagattctatctctcttttcgcttcttttaatttatcaatttggtgttcgatctcgcccagtttatggctgatggtgctgttaatatggcttaatgtgcttgaatggctcatctgttttcacctcgtcttacgcaaaaagtcgtacaaaaagcacagacttttccatactatatttccatatattatattttaaaatagacagaaagcagcttaaataggttaaatgacttattttcagcagccgagatgctcatcattaacgccaaaagactcacttaaacagcatatccattcattgatctcctctatgtatccatgataaattccctaaaaaaaaagagacagtgattaaccgtctcctttgccttgtatcatgattctaataatgtcgttaactgtagtcccagttgtacaaaacgtttgagaaatcttttttcttcaaatcttccggtctgataaagaaattggcgattcccacatctccccacatcgaatcaatgtcatcatctgaatcaatttgcaagagcagaatcgtatggttttgatgggaataagaccgcggatcttcctgggtgaaggacgcatagccgccgattttatggccgaatgcgttcaccgtatattcgtcatacacctcatcgtcaaactgctcgaaatagccgaaggcatccatcccggcatattgcctgaattgaaaatcagacgggagcacccattcagcagacagctcaggggtgatcagcgcttcggattgaatcggaaaatcgtactcctcttcaacctgaacgaaagaaaaatcatccatgagctcctcttcccgatctgtcacgtgctcaaaatacttgacgcagaaacccgtttgcgcgcacccgtcgtcaaaattcaaaccgtatacgtcatcactgaccgatatgtaaaactgaagaatgccggtgtccggaaaatcaggaagtccgggcatatccgcaaaattgatttgggcgagaagcttcatcggcctgccgctttcatcttcagggtatggttcatgttttggaaaataggggtctccggcaattttactgtcataccgtcccgtttcagcttttttgacgtgcagtttgataaagggccgtgctgacgtttccagcagaccgcgggatgattccatttgcttcggcaatttccatgtgttttccacgattaatatctccttcgtctctattgattgtatgataaaaggccggcgcggaccgccggcctttcaagtgacagaatcagtctgaggcacgacggctcttcttccgattgagatatattccacgcccgcctgttccgcttcctcaagcgagtggcagtttctcccgtcgaaaataaccggggtttccatcagctctttgtacgcttcaagcgggaagtgtttaatttgttcccaatctgtcagaatcaggacggcatccgctcccctgacggcttcttctatggactcccgataggaaaccgcagccggaagcagcccggaagcccggaatgaagcgatcggatcgtacgctgtcatccgggcgtcaagagccgccagacgatccgcaatgacaatggacggggcatcccgcatatcatctgtattcggcttaaaagacagccctaataacgcgatggttttccccgtcacaccgcccagcctgttcagcactttatcaaccagcatggactgctggttattgttgactttaatgacggacttcagcaattcaaaatcatgctccacatgtcccgcgatctgcacgagggcgtttgtatccttcggaaaacaggaaccgccgtaaccgatgccggctcttaagaattgattgccgatccgtttatccaatcccattccgtgtgcgactgattccacatccgcaccgactttttcacatatatgagaaatttcattaataaaactgatttttgccgctaaaaatgcgtttgacgcatatttgatcatctcagcgcttctgatgtccgtatgatataccggaatcgcaagcggcgcgaaaacccggtcaagcgtttcccgcgtctgccggtcttcagccccgatcacgatgcggtcgccgtgaaaggtatcgtgaatcgccgaaccttcacggagaaattccggattcgaagcgattgaaatgttcacgtccgctctcagccgtgaatgaataacttcgctgattctgtcattcgttcccacgggaaccgtgctttttgtcacgacgatcgcatctttagaaatatgttcggcaatctgttcggcgacattttcaatataagtaaggtttgcgtgcccgtcttctttttgcggcgttccgaccgctataaaaataacgtccgcttccgcaagccctttttcgtagctcgtttcaaatgccagccgatgccggccgatatttcgtttcatcatatcttcaaggcccggttcaaagataggggacaatccctttctcatctgctcaaccttacgttcgtcaatatctatgcatgttacgtcatggccgatttctgaaagagacactcctgtcacaagaccgacgtagcctgttccgatcactgttattttcatcgtgttcccccaaccgtttagaaattgctgctgggcagcttaccgctattatcatatgatcccggcgccggcggaatgccgggagcctgaggccatgataggaaaaaacggcgccggccgctgataatagcataagcataaaagaatcatcttgcaaaacagccgcttacgcttcatttaaacgggatggagacgacgattaaaaaagaccccagcgcttacggcgggccacaggcagcggaggttccttataaacggctttgttttcagcgagaagcgccgcattttccgtgagcatgtaaatcagctccgctcctgcttcttttttcagaacgctgatcgcctcctgataataaaaatttctcggtccgagattatgggcgtcagatgcgagaaagtggatcaaattcgcttccatcagctgcagcgaaaaggatttcgctttccgcccgaatgctccggcaatgcagccggccgtcacttgggcggccgcccctttcttcacaagactgtaaaggacggaaggattttcgcgaatttccctgttccgctccggatgggcgatgacggggacatatccgttcagctgcagttcataaaacagcctttcagcataggccgggacatgatccgccggaaattccgccagcacatactttgtattatggagcggggcaagcgagccgctttgaagacctgccagcagatctccgtctattctgatctcctggcctggcagaacagtcagcggaatgccttccttattcaaacgtttgtttaacaggctgaccgcttcgttgaccgtatgccgatccgtgtcatagcggtatttcacatgatgcggcgtcgcgatgatcgtatcaatcccctgtctgaccgcttctctcgccatcttcaggctttctgtatcatccgccgcgccgtcgtctatggaaggaaggatgtgacaatggatatctatcatatttcaatccctccttaaaaagaatggaccgcgcccattgtgacattattgtccgtaataggcgtagtccgaatgtttcgtttgtttcttcccgttcataacggccccaaggagcttgcacgggcagtaatcgagcgcttctttcgccttggccgctttttctttgtccgttttcccgcttgagatcaccataatggccccgtcagtgtagctgcctaatattttcgtatcggctacggccaaaacgggaggcgtatccaaaatcaccttatcataaactgcggctgcttctgacagaagatctttcatcgcacccgtcgataaaagctccgccggattgggcgggctcggcccgctcgttaaaatatccaagtttgcttcatcagccggcaggacggcattctgaaacggcatctgttttaacagcagcgacgttaatccggttccgttatccaatttgaaggtgaaatgaaccgtcggtttgcgcagatccgcatcaattaaaagcacttttttcccctgctgtgcaaatacgacggcaaggttggccgcggttgtcgattttccttcttccggaccggcggatgtgatcaaaagggacttcacctccgtatcaacggaagaaaattcaatgtttgtgcgaatcgtgcgatattgttctgagttgatggatttcggctcagacatcgcaatcacgcttcgttttccgggtttgtcttttttacgcgtcaacatgtccgcctcccgcttgtttggtttccgccatcctcaagcttttggcaacgctgtctttagtactgattgaagtaaccgttcccaggatcgggatgccgagcagcgcttccagctgttcttccgatttgatcgtattatccagatgttccagcaaaaaggcgagaccgattccgcccaaaagtccggcggcaaacgcaatcgcgatgttcagcttacggttaggctctgccggtgactggctgtccgacacttcggcctttgaaaggatgctgacattatccacgttcatgatggcggtgatcttgtcctgaaaaacggatgcaaccgcatttgccataacggccgcccgcttagcatccgtatcccgaacggcaatcgtcacgacttgtgaatcctgctcgctggataccgtgattttcgattccagctctttcgaagtcatggacagatgcagctgtttaatcacctcatcgaggatgaccgggcttttgatgatgacattatacgtgttgattaattggaggttggtttgaacgtcattgaattggacttctttttgattgtttttggattggctgaccaaaatttgagttgagttttcatagaccggcgtaagagcgaagaaactgatgagaccgcctgcggaagatgccgccgcggtaataataagtataaacagcagacgctttctcagtattgcgaatatttcctttatgcttgcagattctcccatataacctccatatcactttccgtgtattcccattccctccaatgatcttttccaattacgattatacagctttaaactgtcatttctaaccttttcaaatgacaaaattcgacaaaaatagacaatcacttcaatctgtattatatttgtaagcgctttaaatactggtgtcacaggaagattaaaaaatcccgcggccaggaggctgcgggattttatgttgcatatccatttttaatataagaaatcaaattctcaagcatttcttttgtggtcatctcagaggactgctcaccgatgtcgtgcgcatgcattaaaatcttcagaaactcctcttgatctaacttcgttttcttcatcattcgtttcctttcggcttccattaaattgaaaacaagattattatatgctgtcgggtgctgttttgcaatctctaatacatcattcgacacattcgggtttttatgtccttttttaggaaaaactttttccgggccatgtgttgcgatataatagaggaattggaatctttttattttgtgactcgttaggagcgataatcatgcttcaggatatgattgctaaagaagatgtgctcgcagcggctgaacagcttaaagaacttcttccttacaatgaagacaatgttcagctgatgaagaaagcactcattttatatcggcaggattccgtctatcgtatacaggttcaaaccccgacagagatttccgcatatgtgcaggatgttgtgcctgtaagggtcacgctgaacttatttttcatggtgaaaagcggctgcgcatgcccgtctgaggcgatctgccgccacgtgctcgccgtttttctttacgtatatgcccaattcgagcgggtcggtacctttaccgaacattggctggaaggagaaaagcttgaggaaagcagggagcttgtccgccggcagtttcaggaaaaagtgctgccgaatgaagagtcgctgtcaagctggctcgctttttttgattcggaattctcgctgtgggaggcgcggacgccggccggaagccagacgatgcagggcctttattacggctatctgtcagcgctcaaaaaacacgccccgaaaaaacccgagcttaaaagcttatatcagattcattcggcgcttgccgtctggcttcacatgttcactttgattgagtcaggcagattggatgccgaaaaagattattacagcattaatccatacgtggaacagctgatggatacgatttattcctccattgacagactgaaaacgtacgccttgtctttttcactcgatccttttttagaccggacgcccccggtgctccgcagactgcttgtgaaagaagagctttttcaatacgaacgcctccgggtattcggtgaaatgtggagcgcgcttttgaaccggccgaaatgggtcgcgcgtgaacaagagattctcgaacaggaaagcgggcgccgtttttcgccggaagtgcggttcggacggcttcatctggcctttttgcaaaaagatgatgaagcggtctttgaagatatgtcccgcttccctcctgaagcgctgccgtacacttttcaatggctcggtgaactcaccgcgaaaaaagactggaaacggctgaaaacatggtatggccggatcgaaccgcttgccgtgaactatacgaagcttgataagccgtttaaagaaatgcgcgacatcatcggagagctgtttgcgctgttggcggattatgcgcggcactcacgggatgatcagctgtttgaacggtttgcttccggctgccttccctatacctttaccgaatacagccagtacctgtacgaaaaacggcggtacgcggaatgggtggagattcacagcctcgtcggtttttccgtctgggaaattgaaaaggacatcctgaaggaaattgccgccagtgatccggaagcgctcatcccctcctatcaccgggcggcggccttttttatcgaccaaaaaaaccgcagcgcctataaagaggctgcgcgccaccttaaaaaactgcggacgctttataaaaaggcaaaaaaacagcaggtatgggagcgttatatcagccggctgagcgcaagctacaagaggctgcgcgcccttcaagaagaattgcagaaaggaaagttgattgatggcgagtcttaaggaaattttcattcatgtagaacaaatggaagattggacatttacgctgtcaagccatgatgagaaggagcagccgcttactctcagtcagatgaagactcatttgttccaatggcatgagtccaccttttacggaacgtttcttgaagacgtcagcttcatcggcactccggccgttctgctcagcccttggatgaccgtcgagcttcttggaaaaaactcgttcaattcattcagcaccgtgcagctgacaaaggaaacggaaccgttaatcgaagcggcttcgacgatatacgaatttattgctgacggcgattttcttccggattatgacgcatggcaaaatggcgtcctgcgcttcaaagaccgcgagcttttgctggaaggctttacggcagactggttctcagccgcggtacaggactacattcagtacaatgatgatctgctggaaaaatggcggcggatcgaaacccgttcgccggccgttcatacgtttaaaggctcctttttggatgaagaggattttctggagggaatcggctggcatgacgatctgacgccgtttaccgtcggcctccgattaaacgagcctgatttcgacggtgacgactggaaaatcgagatgtttttacgtgagaaaaaaaccggctccatcacctttttcgacggactgaaagggctgaaaaaagcgtggcaggcatacagcggaaaaatcgcgcgtgaacaggaccgcttccgcagaacggttccctggctttcgtttgattcaggaacgacgctgatatctgaagaagaggcttggatcttcttatcggaagcgagtgagacgcttgtcgatatgggtgtggagattcttctcccatcatggtggcagattgtccgggacagcaatatgatgcttaaggcgaaagtgtcatcctccccgcggggcgagtccttcgtcggcatgaacgctctgcttgatttcaactggagattcgccacaaacgggattgagctgacagaggatgaattcaatgagctcgtcgcaaacaacagacgtctcgtcaacattcgcggccaatgggtgaaaattgatccgcaatttattaaacagatgaaaatactgatggaaaaagcggaatctgagggcctccacatgtccgacgtgctggcgcgcgaactgatggatcacggggaaaacggagccgaggacacggacatcattgactcatcggcatttgccggaatcaagatcgaattatcaaagcatctcagaagcctgatccgcaaactgacggatgccggggatctgccggagcatgaagtcagcgccgcgtttcagggccagctccgcccttatcagatgtacggcatgaactggcttctgtttttacgggaaaacggcttcggcgcctgtctcgcagatgacatgggacttggaaagacgattcagatgatcgcttattttctccatgtgaaggaaagcggccggcaaaaagcgcctgccttaatcattgcgccgacatcggtgctcggcaactggcagcgtgagctccagaccttcgcgccgcagctgaaggccgtgcttcattacggcccccgcaggccgaagggggaagcatttgtcccggcctatcaggacgcggatgtcgttcttacttcttacggcctctcgcacgccgatcaggaagagctttcttccgtgacatggagcaccgtctgccttgatgaagcgcaaaacattaaaaacgcgcatacgaagcagtcccgcgcaatcagaaagctgaaaggcgtccatcatatcgcgctgagcggaacaccgatggaaaaccgcctgacagagctttggtcgatctttgattttatgaacaaaggctatctcggcagtctgaccggctttcataaacgctatgtgctgccgattgaaaaagaccgtgacgaaaaaagaatcaaccagcttcagcagttaatccggccgtttttactgcgccggacaaaacgggatgaagaagtggcgcttaatcttcctgacaagctggaacaaaaagagtttatcccgctctcagccgaacaggcatccctttatgaacagcttgtcaaagatacatttgaacatatggcttctctgaccgggatgcagcggaaagcgctgattctgagcatgctcggccgcttgaagcaaatatgcgaccatcctgcgctctatttgaaggaagaacagacagagctgttaaacgggagatccgtcaaactggaaaagctgcttgacttaatggcggcgatccgcggacaaggggaaagctgcctcattttcacccaatacattcagatgggcaacatgatgaagcgcctcctggaaaaaacattcggagaaccggttcagtttttaaacggaagcctgtccaagcaggaacgcgattccctcgtcgaacggttccagaagaaagaatacccgacgctgattttgtcactgaaagcgggcggaaccggcctgaatctgacggctgccaatcatgtcattcactatgacaggtggtggaatccggcggtggaaaaccaggcgaccgaccgcgcctaccgaatcggccaggaacggttcgtccacgttcacaaactcattacgacgggaacgattgaagaaaaaattgatgccatgctcgaaacgaaacaaactttgaacgatcagattatccaaagtgaaaattggattaccgagctgtcatccgatgagcttgaagaattattcaccctcagcgcatcggcgcaatcacattaaacgcaaaaagaccggctctctcggaagagccggtcttttatgtcgtccttactgttacgccgcatttgccatgaatgcgtcacgccagtcatgaacagtatcgccatacctttcacagtaaattcctgatcatatacgcaacgccgttttgatcatttgtcaatgtaacggcatcagcgatctctttaatatcttctctcgcattccccatcgctatgccttttccggccgcctgaagcattgaatagtcatttaagctgtcaccgaccgcggcggtttcagccatcggaatgccgagcttttgcgccagccgtttgagcgcctgcccttttgaggcgtttcgagacgccacttcaaagttgtgatcggcagagctgacaagggtgagatctttctgaccgctgaatcggtcccagcccgctttcagcttccgctcatcaaacgaaaatccgagaatattataaaaatccagatgctcttctttctcaaagagctcacggtatgaatgaatgtaagcaaagccggactggctgtattgcactgaagccgcctgttccaaaacggaaagatcggtttccggattggcgcttttcacccggtccatttcgatatcgagcagctgcctgccggtttcaggcgtatagatggctttgtttgtaaacacctcataataatattgattctcttcaagccatgacaaaatcccccgggctcttgtttcttcaatcgcttcacaatggtacaggctgccgtcaggagcatgaatggcggctccgtttgcgctgataatccatgtttttatgccgagcggttcgaatatggagtgcacatcaaaatgcgcgcgtccagtggaaaccacgatttcaattcccgcttgccgggcttcccttaaagcccgcttgttttcatcgcttacttgatgactgctgttcagcagtgtgccgtccagatctatggcaatcagtttcacatgtcctcatcctcttcttcagattcagttacaagcaattctacgccgtgccggtcgagcagatcgcaaaaatcctgatcaggcagccgatcggtaatcagcaggtcaacctcgtgcaggtctgcatactgataaaaactcgtacggccaagcttcgagtgatcgctcagcgcaatcacctgttcagcctgacggatcattttacgctttaccatgccgtcttcttcatgcggaatcgtcaggccgttttccgagatgccgacaacgccgatcagcaccttatcagcgtgataatcccccagtttttctacaacggaagccccgtataaaaaccggtgttccttctggagctttccgccgagcaggtgaatatcaattccctcttttgcggaaaggatatcggcctgattgatcgaatttgtaataacagtgcagccggtgacatttaaatgctccgcgcaggcctgaacggttgtcgatgtgtccaggatgatccggtctcctttatgaatcagggatgcggccagcttgccgattttgtttttctcttcagaaacggttttcagccggcccgaatagcccggaacttcctgattcactgacggcagaatcgcgccgccccgtgttctgataatggcccctcgctctttcagctttacaaggtcccttcttgcggtatctcttgaaatatgaagcagcgaacatatctgttcagcggtgatccgccggtgctgtttcaaatattccattatcgcaatcagtctttcttcttgatacacgtcctcattccctttttttcgtcacttatctgtaagtaattataagtttttatcccaatatattcaatgtttttaagtatttataagcgaaatcacttctttttaaccatttttcagctcccgcacaaaaaaaccagtctttcgactggcgaatgggaaggaggtattgcggggcccgctgaaaggcgggaaatcgaggaaaaaagcatgctattcagccagcggctctttccgtttttgatccataaaccgaacggtatcagccatgacctcggtcacataaacttttacgccgtctgtcttttcatagcttctcgtctggattctgccgcttacaccgaccattgaccctttttggcagtacaatgccgtgttttcagcgtttttcctccagatggtgcagttgacaaagtcggttccggtttcacccgacgcgcttttaaaattgcggtttaccgccaacgtaatatgagcgacgggaatgcccgctgatgtaaaacggagctccgggtctttcgtcagccggccgacaagcataacgtggttaaacaagccgtctcctcctctctttttcgaggctggcttcattgtagtacaaaggcttatgaaagcaaaaagcggaaaaagccgttatccgtttgggctgcttttatgtttttgtttttctttctgataaaaaaaacttttgtttttgaccgcttatgtaatatgtatttttgagcagccgcgagaaaagtttcgttttgagccagtctttctcaaacatgcggacaaactttccgccgtcccatgcgaaccagtaaaaactcagctttttatcagtcaatgaaagctgaattttatactgttccatgcggtcttttgtttcatataaaaagacgacatttccccttctgttaagatgcacctcacaatcttcctttttgcataccaagtaggaatgatcgtcttttcgccttgaaccgtcttctatatagatttccttcaggcgcaattgattcataagcatctctccatgaccatattcttttacattataatgaaaaaatagaaatgattaaatgttgaccgcctacaaaaatgatgaagcatgtcttacagcattttcccgggaaaaatgatatgtgttataataaatgaacgaaaaacatggacaacaggggtgaaaataagagatgaaaacctttaaactggttgatctgaatgtggaacgtttagataaagacgatcagccgattgaacagtttccccttttagacggattgattatcaacaaagaggacggagaaaaccactggttaattgaagcactggtcccggccgaacacttttctttttttgacatgctgatgaaaagccagaaagaagcgaaggtgtttgtaacgattacgaaaaaaagcaaccgccccgcccagctgacgggaagcatcaaaaatattgtggagctggaaaagagtatacaagttttaatttacggtcaaatggtgtcaagaaaccaccccggatcagaaagcattctggagtcgctcgtgaaagaaggctactcgggcagccggctgattgaagcgtttaaacaaaaattataatcataaaaaaggccggacgttaatcatccagcctttttttgtgccttagtcattgtgaggagcccgctgtttcagcagatctctgatttcagtcagcagttctgtctgctgatctgtttcttctgcttcttcagcctcttcttctgcttcttttttacgtctcagcttgcctattgtgcggatcacgataaagatagaaaatgaaataatgaagaagttcacaatcgtttgaatgaagcttccgtacttgatatgagcatcgccgaatgtcacggccagccctgaaaagtcaagaccgccaagaagcaggccgacaagcggcatgatgatgtcttcaacgagcgacgtcacaattttgccgaaagcgccgccgatgacgacaccgattgccagatccatgatatttccccgcatcgcaaagcttttaaattctgaccacattacattcacccctttctatacaaaatgggcttttttataagcccattcgtttgtttttattctccgagcgcaaatgttaattcagcttcacacacgagctcgccgtcaactttggcaacgcctttgccgcgtccgatcgtaccgcgcgcgcgggtaatatcaacctcaagctccagcttgtcacccggttttacctgctttttgaaacggcagttatcaatccccgcaaaaaatgcgagtctgccccggttttcttctttaatcagcatcgcaaccgctccgacctgcgccaaagcctctacgattaagacgcccggcataacagggtattcaggaaaatggccgttgaaaaaatcttcattcgccgtcacatttttatatcccgccgcccgttttccttcttcgacttctgtaattctgtctaccagaagaaacggatagcgatggggaataatttctttaatttgctgagtatcaagcattttcttgacatctccttcatcgacaatagtatgtatagaaggtatatgcgctaaccaatctgtacatttggaagtatattatgaatcaatttctttttcaaccgcgctgtaaactgtaaccagctggcaatgagcctcgtccattaatgtgttatgataaataaagatttttaccctatgcaaagaggttggaagatgattgctaagtttactgaaaaacgtacgctggtgatgctgaatgagtggtatgacgccatgggaaaacgccaattcgatctagcccgttcccttcacgaacaaatcaatcagcatctccccaaattacaaaagaacgcaaagctcaaactcagatatcagctgtttttcgcacggtttcagctgctgtttgagaaaaaagacggtctgactaaattgttctgcgagctgaagcggcgcaaagatgagatggatcatgaattaacttattatttctattttttcaaagggttattccatatggtgaatggcgctccgaaccgtgctgtctgccgctttaaagaagctgaacagtacctgccggccattcaggaccgttttgaagccgctgaattttattataaaacagcgggtgcatattacatgatgaagtcgcctgcgctctccattcaatatgtcaataaagcgctggaaatctatcaaggtgaattcggctacatcaaaaaaacgctcagctgccggctgcttctcgccgtgaattacatagacgaggcacgctatgaagacgcagaacagctctttaatgaatccataaagataacggaccggatcaatgacaataacctgctgtgccacgcctattataattttggttttttaaagaccgcccagaaaaaagataaagaggccctccctttttacaaaaaggtattgggcaatcagcgtttcgagaaagagtctcccgtttcctacctgcattgtgtatacgaagcggtcagagcactttttaaaaccggatatgccgccgaaggacaaaccgtgctgcagaaaggtttatacatatctgaaaaagtgcagaacaagattatgaaattgaagctgaccgcgctcaacatactgtacaccgctcaggaggacccgtacgaccgattgcagaaactcgtgctggagctgcagaaaattgaagcgtgggtggatttggaagtgctgcttcaggatattactgattactacaaaaaaaagggcgattttgagaaagccgcattttttatcatgcgcggctgatcaaaacgccccttcttttatctgactgagttgattaagcccagcatttggtctcccaatgtaatcgtgcggctgttcagctgataggaacgctgagacacgattaggtcggtcatttcttttgacatatcgacatttgaactttcaagcgcgccctgctccatgccgattgcctgccggtttgcgccggtaagctcttcaatcgctgatgcccccgcaccgtttacggaaaacagattatccccttccgcatgaagcgcctgaggattattgacattgacgacaccgagattaaacgtctgcgaacgggttcctgccgggtctgaagcagtcagcgttccggttttgctgattttcagctgattcagcgaactgtcaatttgtatgggctggccgttctcatcgagaatgggattgcctcccgctgtcatcagctgaagcacccggtcatttccgccggccggcttgagggaaagtgagccgtcccttgtatacacccgccgtccgtccgcttctgcctgaagatattgataaggtgaggtgaacgcgatatcaaggtcacggtcggtttttttgatgcctccctgccctgagtccagctgcggagtcatgaccgttccggcgccgagacgcaggccgggcggcgttttccgcatgttcggcgaattttcctttttgtcatctatatggtcatactgctgtctgatcagctcggaaaagcgggagtccctcgctttatagcctgtcgtatcactgtttgaaaggttgctgctgactgtatccatctgctgctgaagctgatttaaggctgttgaagccgtcagcattgatctgagcatcataattgaacgtcccccattttgttacactttgccgatttcatttgcggctttatccatgcttttatcgtaagcctgaatgactttctgattggcttcaaatgatctgtatgcttccgtcatttctgtatacgtgctcgtcacgtccacattcgaaagctccgagacgccttgctttaatgaatacgagacctggggattcgccgccgcgctcggcagttcagagccgtcggccgtgctgtataggtcattgccgtcccgtttcagattgcgcacgtcttcttccattctgatgtcaatctgcccagccggccggccgtttgtcgtgaccgttccgttttctgatacggtgaatttttcactgtcgactgtaatcggctgtccgtttgttgataaaacaaggtttccgtttatcgtaagctgattgttttcatttaatgagaaagtgctgctttttgaataacggacgccgcccgcagtctgcacgggataaaacagctcggcgttttcattcgtttcggcattcttgggaacctgattctccataagcgcgatatccatcggctgatcggtcgttttcaggcttccctgcgtaaacaacggtttcagctcctgcatgtatacgcctgtgttgacggaaccgattttcgtttttttatcgccttctattcggctcagaagcatctcgggaaaggcgcggattgaaccttgatcctctttgtatcctgacgtattcgcgtttgcgatgttatttgacagcatttccgttcttctctgctgtgtaatcattgcggacgttgcggtatataatccttttaacaagtcttccacctctgaaatagcattatttccagttgcctcaccggaacatttgttctataatgaaaatcagcatttttcttattatcggatttacattcccgttcgtgaagggtttgacagaaaaaaaccccattctttttcagaatgaggttttatcatcagctcagtttgcgtttcggaagcttgtccatgttatccagcatgacgccggttccgaccgcaacacaatccatcgggttctcagcgacaagaacaggcaccctcagctcttcggcaagaagctggtcaagcccgtttaacagcgctcccccgccggtaatgataacgccgcggtcgatgatgtcagcggacaattcaggcggtgttctttcaagaacctgcttggcggcctgcacaatgacggcaactgattcacgaagggcttcttccacttctttgctgtttactgtaatcgttctcggcagaccggaaaccatgtcacggccgcggatggtgatttcttcatgacgtgcgtctgggaaaaccgttgcgaccttcaccttaatatcttcagcggtacgttcaccgatcagcagcttatactcgcgtttgatataatttaagatttccatgtcaaacttgtccccagccatcttaatagaagaggaggtgacaatatcgcccatagaaataactgcgatatctgtcgtaccgcctccgatgtcaacaaccatgttaccgctcggctggaagatttccatacccgcgccgatagcggcaactttcggttcttcttcaaggtacacatgctttccgccgcttttttcagctgcttctttaatcgctttttgctcaacggacgtaatattcgtcgggcagcagatcagcatgcgcggttttgagaaaagtccttttacattcagcttattaatgaaatgtttcagcatagcttctgttacttcgaagtctgcgattacgccgtctttcagcggacggatcgcaacaatattcccaggtgtacgtccaaccattcgtctggcttcttcaccgacagccagcactttgccgctgtttttatcaagtgccacaacggaaggctcattcagaacaattccttttccttttacatggatcagtacatttgcagtaccgaggtcaattccaatatcccttgcaaacatctatttatatcctccttgatatctgtttcacagtaaaatatccacattgtgccctaattatatatattatcataatttatcaaaaaaaagctgctgaacgatataagttcttgacaaaattttgcggatattcgcgaaaccgcccggaggagaaaaaagggcccggcagacgtcaggcgctacggctgctgaacgggctccccttcaagaatttcatccttcttgtactttaatttcgtcgcctcgcccccccttaaatgtctgatggatttatgataatcgagtatttcttttacttcattcgccaagtcaggattgatttcaggcaggcgttctgtcagatctttgtgtacggtacttttggaaacaccaaactctttcgcaatgacacgaacggtttttttcgtctccacgatatacttaccaatcttgattgttcgctctttgatgtaatcgtgcacaccactcgacctccccagttggatgtgagaagtgtgaaatgagatccgtattctgtaacagattcactgatgatgcagcttcttcgttgtccgattatataagaaggttttagaaatatgcccacgatccctcacctcaaacactctctttgataggtttgtaacagtgtattagcaatgaattgggaatatgctaaaaactcaataaggacaaggggcgggtcataattttctgctttttgaacggggggtttacatccgcgcgatcctgctgtagaatgaaacagcacaattagttacttaggtaagttttttgaaaaggagaacggaaatgatccacgtcaacagacgcctcattcaccaaatcaatcaatgcgcccgcctgattacgaagaaagccaatgaacggctggaaccattcggcctgtactcctctcaatggtcaatcctatattgcttaaaaacgatcggaccgatgacccaaaaagaaatctggtcctatctgaacgtagaggcgccgaccgttaccagaacgatcaaacgccttgaagaaaacggctggattcagcgggaacagggagaagacaagcgggaaaagctcgtcgtcctgacgaaggaagctgaattgaaatacaacagcatcaatcaagagatgctgaagttcgaggaagacatgcttgcggatttccaagatggagataaggaagctttttctgagtttctgaatgtgtttttaacgaaataataaagaaagggaagtgctgtacttttgagtaaatctgactcgatctggaccaaagattttattatggtcgtactcgtgaatttatttgtctttgtgttcttttatacatttttggccgtgctgcctatctatatgattcaggagcttggcggcagtgaatcgcaaggagggcttttgatcagcctgttcctgttatctgctattatcacccgtcctttttcaggggcgattattgaacggttcggtaagaaaagaatgacgattgtatctctggcgctgttcgccctgtcttcttatctgtatttgccgatacacaatttctatctgctgctcggactgcgttttttccaaggcatctggttcagcattttaacgacggtcacaggcgcaattgccgctgaccttattcccgccaagcggcgcggcgaggggctcggttattttgcgatgtctatgaaccttgccatggcgatcggtccgtttctcggactgagccttgtgaaagtcatatcgttcccggtgttctttacgctttttgctgtatttgtttctttaggcttgctgattgcttttatgattcgtgtgccggatcaaaacaacagcggaacgactgtgttccgtttttctttctccgacatgtttgaaaaaggcgcgcttaaaatcgcgattgtcgggttgtccatttctttctgttattcaagtgtgacttcatatttatccgtttatgcaaagacgatccacctgttggatgtcagcggctatttcttcgtctgtttcgccgtgacgatgatggccgcccgtcctttcacaggaaagctgtttgacagagtggggccgggaatcgtcatctatccgtcgattatcgtgttctccgcggggctttgcatgctggcgatgacaaacagcgccctcatgcttctcttgtccggtgccgtaatcggtctcggatacggctctatcgtaccgtgtatgcagacgctggcgattcagaattcgcccggacaccgttcaggctttgcgacggcgaccttcttcactttctttgacagcgggattgccggcgggtcatatgtattcggcctcttcgtcgcttcggccggattccattcgatttatctggcagcggggctgttcgtcctgattgctttgctcctgtatggctggagccagaaaaaaagaacgccgcttgaagcggacggaaacgtttcaatcgcagactgatatgacaaaaagccgggggcagcccccggctttttttattcggccgctctttcccgcacgattcgtccctccgcttttgcataaggaggatgaatgtacataagcgccgtataaccgagacatgacaaaatgacacccgcaaaccaggagatatcatagatgccggcgaacgccgggacgtacatcccgattaaagaaataaacgcgccgagaaacgtcgcggcaaaggcccggtaattatagcctttgtaataagtgtactgtccggtttctgaataaaggtcttcaactgagagctgcctttttctgatgataaaataatcagccatcatcaccccggccaccggtccgagcatcccgccgatgagtccgagaaacgcatatacattcgtggcgctctccatcagcttccacggtattgtgaacagagccaaaacggcggtcaaataccctccccttctgaatgtaatatacttcggcaggacattcgccaagtcataggccggtgacacgatgtttgccgccacgttaaccgagacggcggcgatgcaaagtgtgatgaccgaaagagcgataacgaaaggattatcaaaccgggccaaaatctccaccacatcccaaatcggttctccgaatgctacctgtgatccggatgtcaccgtgatgcttgcaaacgcaaacagcgcaaacgttcccggcagcccgtaaaactggccgcgaatctgttctttttgcgacgcggcgaaccgggtgaagtcagggatattcaggatcagcgtcgcccatattccgataatgcccgtcactccggcggcaaacggccaaaacgtttcagaaaatgtatggaactttcccggctgtgagtaaatcggaccgagcccgccggcaatatctatcgcccaccagaccatgccgccgaagacgagataaacaagcgggcccgcccacacttcaaattttttgatcgattccatgccgtgccgcagcacaagcagatgaatgccccaaaagaaaatgaacgacagaaagcccggcagatgaagcccgaatatattccaatctccgccgagactcccccagcccggccatatgttcaaaagcagaatgtgtaaggcagtgctcccggcaaatgtttgaattccgagccacatgatggctgtaaacgccctgagaagcgccggaatgttagcgccgtatattccgtaagaagccctgataatgaccggaaaaggcaggccgtatttcgttccggcatggccgttcaaggccaaagcggcgaacaaaatcagtgacgccgtcacgataatggcgagcacctgccacggagaaaggccgatcgcaatgagcccgcccacagtcgcgtaggtcgggatattatgaatacaacccatccagatggatgcaaaattcaccgccttccatgtccgttcgccgtcttctaaaggcagtaaatctttgttgcttagccgatcactcgttatttttgtcattttctccctcctgcatgtacgttttccttacatcacatgtgaaaaaatataactgaaaattccgcaaataacattggtcgctgtcgacaataatcgttttgatttttgagcacattacacaaaaaaagagacggggagagcccgtctcttttttttgcgcctgttaagaggcttttttgaggagaaccgaaaaccggaacgccatcaaaaggcttacggcgccgacaacgataagaatcgtgccgagcatatgaaaatggccggcggtaatttcttttccgaaaagaatgcccaaaatgacagaagacaaaatcgaaccgagatacctgcaggtctgaaacaggccggacgttgttccgaccatgtcggcggggctcgttttcagcatggccgcctgaaacgtgacatttccgaaaccgtagccgacacccagcacggacaggatcagcccttttcctatcatgggcgcctgaaggaagaaaaacgttaacagcaccgctccgatcgcggtcaggcaggttccggcaacaatcggctgaagaagccctttcttatctatccattttccggtcaaaggcgacaccagaatactcatgcccgacataaacagcataatcaatccgcttgtctgaacggacaaatgcatttcatcctgaaaatagctcggaagcccgaaaaagatgcagtaaaagaatatattcagcaaaataaattgaatatacaccgacgatagtttccgatgcgttttaaacagcctgacatcaataaacggcttctctgttttcagctcacgccagataaacagcccgacaaataaaagcccgaatacgccttctgtatagtgaggcttcgtactgaaggacaataaaaacgacaggagaaggataatcgctccggcaaacaggagtatcccgattgtatcaagctggcggagcacgcctttcaagccgccgatctcgcgtttttcatctttcggaaacatatacattccgagaaaaaaactgaggatgataaacggcagattgacgaaaaagatcgccggccaccctccccaaacgatcagaaaaccgccgagagtcggaccgagcgccgtcatggctgatgcaaagattgacaggacggccagcgccgaagcctgcttctcctgtatatttgaacggatcaatccgacgccggacggatatatcgcgctgcttccgatcgattgaaaaagccgcatgatcagcaatgtcataaaagtcggcgcaaacggcgcgccgaccgccgagacggcaacaagcagaagcccgatcaaaaacagcttcttcctgccgagcatatcaccgagcttcccggtaacaggctgcgccaccgcgctggcaagataaaaggacgatatcagccaggacaccgttgtaaacgacaggtgaaattcatgctgaatactgtgaagcgcaagagaaatcatcgacgagttcaatgggttcagcatcgtccccgaagccacggccgtcaagaacaggacgcggctttttttggagattgtcattttgtctgtgcgataaattcttccgtcgtccggcttctgccgattttcgggaagataaatttgagtgtcgcttcgtgctgttcatcgctgaatgtcgccatcgcgtcagttacgaaaacttgctgatacccgagctgaaaagcttcccgcgccgtgctttccacaccgatgtttgtcgcaatcccgcataacacaatcgtgtcgattccccgtcttctgagctgaaggtccaggtccgtgccgaaaaacgcgccccactgccgttttgttaccgtataatcgttttctttcactccgatttcaggcacaaattcagcccaatccgccggcggagccgaatggcccgccgcctcttcatccgtcagcggcttcagcgcatccgctccgtcatgaaaatctacgttcacaaagctgataaatccgcctttttcccggaacacatcaattaattttttcgcgttcggcacaacggtaccgcttttatccatcggcacaatgcctttttgtaaatcaataaggaccaaagccgttttttcaaattgcagattcaatgatgttgtcataataattcctcctgatgcagttagtgtttctcaccccgtttattttactctttcccggacaggatttcttccgccatgctccagcgctctttttatggatataaagtcgcatgacacccctttgaaaaagcgacattatgaacgcaaaaaacatgtcagataaccttacacgaaaatgttttatcgttcttttttctctataataatgaattaatcacgattacattttgaatgagacggaggaatacaacatgcagatgggcgatacagtatttatgttcttttgcgctttactcgtgtggctgatgacccccgggctggctttgttttacggcggaatggtaaaaagcaaaaacgtgctcagcacggcgatgcacagtttttcttccctcgccatcgtatccgtcgtttgggttttgtacggatattcacttgcttttgcccccgggaatacatggcttggcgggattgaatgggccggactgaagggggtcggctttgaacccggaagttatagtgatacgatcccgcattcattattcatgatgttccaaatgacgtttgccgtactgacgacggccattatttccggagcatttgctgaacgcatgagattcagtgcttttcttgtattttcctttttgtgggcttccctcgtatatacgcccgttgcgcactgggtatggggcggcggctggatcggccaaatgggcgctcttgacttcgcaggcggaaacgtcgtccacatttcttccggggtcgccgggctcgtgctggcgattgtgctcgggaaacgcaaggacggcacggcggcttcgcctcacaacttaatttacacgttcttgggcggggcgctcatttggttcggatggttcggcttcaatgtcggcagcgccctcacgcttgacagtatcgcgatgtttgccctcattaacacaaacaccgcggctgcggccggaattatcggctggattttaatcgaatggatgctgaacaaaaaaccgaccatgctgggtgctgtatcaggcgctattgccgggcttgtcgccattacgccggctgccgggttcgttacgccgttctcttccatcgtaatcggtttcatcggcgggcttgtctgcttctggggcgtgtattggctcaaaaagactttcggatacgatgatgcgcttgacgctttcggcctgcatggaatcggcgggacatggggcggcatcgcgaccggtttattcgccaccacttccgtcaatgacggcggggcaaacggactgttttacggcgatccgggactgctctggaagcagattgcggccattgcggcaacctatgtatttgtatttattgtcactttcgttatcattaaaattgtaggtctgttcattcccctccgcgccagcgaagaagaagagtcacttgggcttgatttaacgatgcacggggaaaaagcatatcaggacttataaagtgaggagtggcttagatgagcggtcaaatgttcaaggtagaaatcgttacgcgtccggctaagtttgaaacattgaaacaggaactcggtaaaatcggagtcacatcgctgaccttctccaacgtacacggctgcggccttcaaaaagctcacaccgaactgtaccgcggagtcaaaattgaaagcaatgtatatgaacggctgaaagtggaaatcgttgtcagcaaggtccccgttgatcaagtggtggaaacggcgaaaaaagtgctgaaaacgggagagcccggcgacggcaaaatattcgtctatgaaatcggaaacacgattaatatccgcaccggagaagaaggaccaggagctttataaacagacagaacgcccggagacagcatgtcccgggcgtttttttcgggcttcattaaaaagaagaagcctttttttcatgcggggcaggacgcttatgccgtacggtttgttttttcgcatatgtactgatattgaccagtatgccgcacaaaaacagcgtcataatcaatgaagaaccgccatagctgataaacggaagcggcacacccgtaaccgggaggagtccgctcatcgctcccaaattcaagacaacctgaaacattaattgaaacgtaattccgatggcaagaagcttcccgaacgggtcatcagcccgcacggccgtttttacgccgagaagcattaacgcaaaatataatcccaaaacgatcagaacaccgaatatccccagctcttcactgatcacggccataatgaaatcggtatgcgcctcaggcagatagttcattttttcaacactgtttccaagccctcttccgaaaaacccgcctccggaaatagcaaaataggattgaatcagctgatagccgtccccgttcgcgtcaccaaacggattggtaaaggaaacgaggcgcttcacacgataggatgcagaaaatgcgagataaacaacccccgacaccgccgtcgcgccgagcacgaaaagatggcgctttttcaagccggcacataataaaatcgacccgcacgccgccaggattaaggaagccgtccctaaatcaggctccgccaaagtgagcagaaaagcggtccccaaaattactaaaggcggcagaacccctttcacaaattgatgaatgtacggctgctttttcgtataaaccgaagcgaaatacaaaatcatggcgatcttcgccaattcagacggctgtacgacaagcgggcccgctcccagccacctgcgggaaaaattccgctccagcccgattcccggtatcaatacgagcagcagcaataccagcgaaccgaccacaaacagcggtacaagccgcgcataccgcttatacggcagacaggcggcaaatagaaataagcataatccgatcaataaagaggcactttgtttatggaagaaataggatggatctccataccgctgagaccccatcacatcactggcgctgtacaccattaacaagccgaatccgcaaagcagcataatgacaaacacaagcggcagatcggcgtttttcaaacgtttcagcaacggacaaaactccttcggctattcttttcccgcatacttgacgcacagtaatacagtcacgtttcattctgtttacttttttatgattatttttaataccaattgtgtctcatagaaaaaagcattacactgttcatataaaataaagataaaaggtgatatttgtgaattacgaactatttaaagcgatcaatggtttgtcgcaccatagtgccattctcgactctatcatggtatttataacggaatacgccatttacgcctacgcccttttcctgcttgccatgtggctgttcggaagcacaaaaggcagacaaaacgccctgtacgcgggcttcacgggtgttgcggcgcttatcatcaactacctcatcacgaaagtctatgtcgagcagcgcccctttgtcgagcatacggttcatacgctgatccctcatgccgcggatgcttcatttccgagtgaccatacgacaggcgctttggcgatttcaattgcgattctgttccgcaacaaaaaactcggctggccgcttgtgattttcggccttttgaccggcttctcaagaatttgggtcggccatcattatccgatcgatgtgctcggaagcattatcgtttccctcattgtcggattcctgctgttcagattttcaaatgtgcttcgtccgattgtcaatctgatcgtgcgaatctatgaaagtatcgttcataaaagcaaatcgacaaaccataatatataaaaaaaagccggcgtctgtcacagactgccggtttttgtatgtttggctgtatgctttttcctttgtaaagcacagaatgcggcaatgccgagactgtcaatcagcacatcgcggaggcatccgtttctgccgaaaaagagctggacgatttctgtcaggaaagcggcggccaatgcatacagcaccgccctcttcatgcgcctgcgctccctgaaaaacaaataggcgagcacaaaaaatgaaaacgcgtgcccgagcttttgaatcgccgcttccggtatggcgagctccgccatatcgaacacaaagaaaccggacacatccggatgggacgtgaaacggaaggacaccgtctgcgacacaatcatatcgtgaaagctttcagtcaaagcagaaacgaaaacaaagacgagccacccggccgccagacatttattcattcagcatctccttcgttttctattagtataaaggcacatgcagcaatatgaaaagcgcctatcagagctgatagacgctttgggatcaagattacttgcccgaatctttcattgagccgtcatctttaccatctgtcttgtcttttgtgccgtcttctttgtcacctggtttttcttcggtttcttttttaggcgtcacatcttttttctcggaagactgctgaattgacccttccgtttcttctgtcacagcgtttttctcttcagccgccgctttttcaatagatgttaccggcttgtccataaaattgagcgggttcatcgctacgccgtccttgcggatttcaaagtgcacgtgatttccgctttcttcactgtaaagattttttccggatttaccgatgacctggttctgctttactttgtcgccctgatccacgctgacttcagataaagactgatagacagtagacaggccgtctgagtgttcaatttcaaccacataccccagtaccgggtctttagcagctttaacaaccgtaccgctcagagaagcagaaacatcaaatgattttccgtctttctcagctaagtcaattcctttactgaggctgtacgtgttattatagttaacaagtgctgcttctttctctttttttgcggcatcagattcgtaaaactttttcacaacagaaacattttcagaatgagcagccggcattgcgacgttttccattgacttgcctacttcgacggcatcgtctttgccgctgtcatacgcggagtttccgccgttgttcgtcagattgtccttcacatcattcgaaacggattgataccaaaggacagctgttaaaatgacggccgcactgactaagtagattgcagggaatatccagcgtttgcgaaaaaaccgctgaagttttttgacttgagaagttttcttttcttcctctctcatttgttcatcacctcagcaacattctgaacacttttctgaaaatatatacacatccataaaaaacttttttggaagtagtatgtgcagattgcacttaattatgtaatgaaatgtgaagggagatcccggaatatgaatttaaccctgcgcaaagccgtattggaggatttagatgcggtggtggccatatacaactcgacgattgcctcacgaatggtaacggctgatacggaagaagtgacgcccgcagaccggatggattggtttttgcggcacacggaccggcgcccgctgatggtcgcggaagatgaaaccggcaaagtggcggcctggatcagctttgaaacgttttacggccgtccggcctatgacaaaacggcggagatcagcatctatctgcatcaggattgccgcggcaaaggagcaggaagctttctgctgaaagaagccctggcactcgctccggcaatcggcatccgcagcctgatggcttttatcttcagacataatgtgccgagcattaagctgtttgaaaaattcggttttaccgaatggggcgtattcccgggtatcgccgaaatggacggaaaacgatatgacttgaacattttagggagagaactgtcatgatcaccatcgataaagacaaagacgaaaaccagccgctcaataaaaaagcccgttcccttgccgacatcgccaaatggggaaagatcaccgccgtgtttctgatcatcacgggctctctttccgctctgtcagccattgtaacgctgctcggagccattccgggtgttctgctcatcatttccggcgtcatgctgatgcgctcggcaaaagcggctgccgcccttcaggaaggactagaagaaaacgcggaagaaaatatgcttgcacattacgcgtcatttatcaaaatgcagtttttttacgcggcatccagtgtggtactgggcattctcgcttttattttagtcgtcatcttcgctgtcatcggaattatggcttattacagcactgatacgtatgacacgcctgattcatattactatgagaacgatcctgtatttgaatgacaaaaagagctgatcgcgcgtcagctcttttttaataaagcatttcttttttccggtcttcttccgttaaaaattcaataaagctcttcatcgcagacggctcctcggcaatcagccgggtataggcgcttttccgttcctcggacagaatatcgctttttctgattctgttcagcatataaaggcggatcgttttttgcacctgtttccgctgatagccggcttccttaaaaaacgcaagacccaaagccgcaaggagggcaaaaatgccggccgatacgagagctcctctcccggaaggggcctgaatcaaaagcgatgccagatgaaacagactaaaagcggcgagcgggaaagcaagaaaacggtaaatgatgctttttttcatcagcggcgcgatggcgatttgtattttctgaatttctttttttatgaatcccggcaattgttccgcatgctccagcttcatgccctctcccctttgctgtcatttttgtcttctttttcatatatgcatattttacagcacccggaactttctttgaaagaaaactgcattcatctttgattccggctctttattctttcaaaatgtcaatgttataatttgaaatgggaatcagattgctgcacttgtcggaatactaatgggcacagtcttgataaatatgatatagcggggttgcaaagtgagcatttcatttattttattcggattttttttcgttttaaatatacttttggccgtcatcatgattttcaaagaaagacgcgatgccagcgcttcatgggcttggctcttggttcttttttttattcccattttagggtttattttatacctgttattcggccataacctgagacgcaagcacctgtttcaatgggaagaccgtaaaaaaatcggaatagaaaagctgctgaagtttcagctgaaagatctgaagtcgaggcaattccaatttaacaacagggcgactgtggataataaagacctcatctatatgcttgtcatgaacaaccacgcagtctttacagaggataattcggtggagattttaacggacgggcgcgataagttcaaacgcttaatgaaggacatttccaacgcaaaagatcacattcaccttcaatactatatttataaaggtgatgaactgggaaaaaaattgcgcgatgccttagtgaaaaaagcacgggaaggcgtaaaggtcagagtgttatatgatgaactcggttcaagatcactcagaaaaaaattcttcaaaccgctgcgggacgccggcggccatgtggaagtcttttttccttccaggcttcgtccgattaatttgcggctcaattatcggaatcaccgcaagctcgtcatcattgacggcgaaaccggctatgtcggcggctttaacgtcggagatgaatatctcgggctgaatcctaaattcggctactggcgcgatacgcacctcagacttcaaggcacggcggtacacgccattcagacacggtttattctcgattggaaccaagcttcccatcaccatacgctcacttacgttccgaatcattttccggaatgcgagccgaagggcaatgtcgggatgcagattgtcacgagcggaccggattcagaatgggaacaaattaaaaacggctatatcaagatgatctcaacggccaaacggtcgatcctgattcagacgccttactttattcctgactcaagtcttttggatgccctcaggatcgcctgtctgtcaggcattgacgtcaaaatcatgatcccgaacaaaccggatcacgctttcgtttactgggcgactttatcttacatcggcgatcttttgaaagccggagcctcagtctacatttacgataacggctttattcatgcaaaaacgattgtcgtcgatgatgagacggcttcagtcggtacggcgaatatcgacgtcagaagcttcagacttaattttgaagtcaacgcctttatttatgacgtcaccatcgcaaaaaaactcatttcctcatttaaagaagatctgctcgtctccagaaaatatacgtatgaagaatatcaggagcgttcgctgcggatccgcattaaagaatcgatttcaagacttctgtcgccgattttgtaattcccgggatgtttctcgggaattttctgatataaaaacggacacggcatgaaaaagcacattttttattcaaaagaataaccgaatagtgtataaatgaaaagtgagtatttttttgtaaaggagtgccatagtttgaaacctgaatcagtgaatcgttcgcttatttctatttcgaaatggggaaaagcgacaggtattttatttattattataggcgcgtttgcggcgctgtcgggcgcgtttttctttttaatcggagccattcccggcgttttgcagatcattgccggcatttttctgatgcgctcggcaaatgaagcgggacagatggcggcgcagttcaatgaactgacagaggaacatatgctggagaattatgcaaagttcgtgaaaatgcaagggatctatctgatcgtgacggtcggcttgtctgttctcggtatcgttcttttcattgtcctcatgacgctcggcatcgtggacgacgcgtttaataatattgatgccaatacatattaaaaaggaaaatcccggcgcatccgcccgggattttttcttataccgcttctccgacaacggtaaagtttttctgcttcggatttgccaatacggcgaacagcattgacgctgtatgcagatattctttcggcaaaaaagttttttcaaataaaacgtttcctcagagtttcaactgaaatcactcagttctgcgaaataaggctatggcggtacaagaccactcatcatacaattttttgggtctttgtaattaaattacaattgttcttaatattcacccatgtattcatgctattatattgaaaggaacgatcaaaagcgttggcgttcgttaaatatttacgagtgctgcctcatgtcaaagtcagaaaaaatagtataggaggtaacatatgtttaagtttaaaaagaaattcttagtgggattaacggcagctttcatgagtatcagcatgttttcggcaaccgcctctgcagctggcacagattactggcaaaattggactgacgggggcgggacagtaaacgcagtcaatggctctggcggaaattacagtgttaattggtcaaataccgggaatttcgttgttggtaaaggctggactacaggctcgccatttagaacaataaactataatgccggagtttgggcgccgaacggcaatggatatttgactttatatggctggacgagatcgcccctcatcgaatattatgtggtggattcatggggtacttacagacctaccggaacgtataaaggtactgtaaagagtgatggaggtacatatgacatatatacaacgacacgttataacgcaccttccattgatggcgataacactacttttacgcagtactggagtgtccgccagtcgaagagaccgaccggaagcaacgctgcaatcactttcagcaatcatgttaacgcatggaagagccatggaatgaatctgggcagtaattgggcttatcaagtcttagcgacagaaggatataaaagcagcggaagttctaatgtaacagtgtggtaacagctcatctctaatgaggggcagctaacgggctgctgatcgttccttgagaaattttataatgattgtgaagaggcgaacggttttggcattaccggaggcaggatattctccatcagtttttttagcgcgtattaaaataagagttccgtctttttttggtaacccgcttccaacagacaccttcacataagccttaagcaaaataaaaatatcccggttaccacctcctttagtttcagaggttttcttcattaaacagatcgcaatcccgcatccaggcttgtctgaatatggagccaaaaccgtgatttcctcattatccattgtaaccattttcgttacacgtctagcggcatgaacccatctctttttaacaaaagagatgattcattacatcataaagggacttgctcgcaagttcattctccattgcccgctgtacgcttccgaacgtctcatcgagcgcgcgctgaatatttttgccgaccggacagtcgggattcggattgtcgtgaaccgcaaaaagctcttccttattctgcaccgccctgtaaacctctaagagggtgatctccgacggatcttttttcaggctggctcccggaacacccgcccgggatgtcagaatacccgcttttttcagctggctgatcgttctccgcactacgacgggattggtgtttacgctgcccgcaatcatgtccgatgacgcccgttcatccgttgagatcagcgataaaatgtgaatggccacagcaagacggctgttaatcatgtttttcaccaccattgtaaccaaaatagttacatttcatttgtttgtcaactactaatatacactaaaacgggcggcaggatgaaatcaagttggcaatagagggtaaacaggccggcgggaaaccggccggagagggattaaaataagaaataacgctgtcctagcggaacatagctgacgggctggcatgccagctcttctccgtcggcgaacacctgataggttttcggatcgacatgtatattcggcatcgcgtcattcagcttcatgtcgagcttactcagcttacggatattccgtacgggagaaatcattttttcaaggccgagcttttccggcacaccgtttgcgataccggcctgggacataaatgtaatagaggtattgcggtttgctttaccgtatgatgcgtacatctgccgcataaacacgggctcaggcgtcggaatggaagcattcggatctcccatctgggcgcgggcaatcatgccgcctttgagcacaagttcaggtttgacgccgaagaaaaccgggtcccatagtacgaggtcggcgagctttcctttttcaacagaaccgacttcatggctcagaccgtgagtgacagccgggttgatcgtgtatttggcgatatagcgtttggcgcgcacattgtcattgccgttttctcccgatagagcgccgcgctgttttttcattttatcggccacctgccatgtccggataatcacttctcccaccctgcccatcgcctgcgagtcagatgacgtcatgctgatcgcgccgatatcgtgcagaatatcctccgccgcaatggtggccgctctgatgcgtgaatgactgaacgccacgtcttcaggcacttttgaatctaaatgatggcagaccatcatcatatcaagatgctcgtccatcgtgttgacggtatatggaatcgtcggcgtcgtagaggacggcaggatattggcgtaagatgcgagtttcataatatccggtgcatggcctccgccggctccctctatgtgatatgtatggataacccggtcgccgatcgcatcaagcgtattttctaaaaagcccgcttcatttatcgtgtctgtgtggatcgccacctgaatgtccgcctcatccgctgcttccatgcaagctttaatggcgcttggcgttgatccccaatcttcatgcagcttcaggccgatcgcgcctgcttccacctgctcgatcagcggcgctttatcggatgcatttccttttcctaagaaaccgacattgatcggaaactcctcggccgcttccagcattctcgacatgtaccatgcaccggatgtacaagtcgtcgctttacttcccgtcgcaggacctgttccgccgccgagaagcgtagtcacgcctgaagaaagcgcgacttccatctgctgcgggcagataaagtggatatgcgtatccaccccgccggccgttacgattttcccttcgccggaaatgacttctgttccggcaccgataatcatgtgcgggtccaccccatccatcatatcagggttgccgcttttcccgacgccgacaatccggccgtccttcaccccgatatccgccttgacgattccggtataatccaggatgacggcgtttgtaatgaccagatcaagcgctccgtctttcccggtgatacgcccgttctgccccatgccgtcccggattgttttccctccgccgaaaatcatttcttccccgtaattcgtgaaatctttttcgacttcaatccataaatccgtatctccgagtctgactttgtctcccgttgtcggtccgaacagttctgcgtattgctcacgcgacattttcatcggatcgcctcctccatccatccggcttttttaagatttgacagcgtcttctcttttccccgctcatccatgtacgtatcggccatgccgttgagacctctgaccgtttttcgccctccgatttccacgagcgtgacggttttctcttctcccggttcaaaacggacagatgtgcctgacgggatatcaaggcgcatgccgatggctttgtcccgattgaaggaaagggcgccgttggcttcggcaaaatgaaaatgcgatccgacctgcactgaccgcgttccgttattggtgactgacacctccagcgtcttccggccttcgttaatggtgatggtcccctttgcgacttgaatcgctcccggcttcatgacttcacctccgctttgatcggctgatgaacggtgacaagcttaaccccgtccgggaacgtcgcttccacctgaatgctgtccagcatttccgcaacgccttccataacgtctttttccgtcaatacattgcggccggattccatcagctcagcaacgctttttccgtctctcgcgccttccatcagataacaggtcaaatatgcggcggcttcgggataattcagcagaacgccgcgcgccttccgctgcttagcgagctctcccgccgtaaaaataagcaatttttcttgttcaaccggtgtcagtttcatctgtattcccccttagtgatagtcaaacacaatccgcatggtcataccgaaacgatgcaggcggccgtcacccccttcacctcatgaaatgttaagtgataaaagttattcgacagtgaacggcccgattccttttgcagaaatgaccgatttctcatttttttcttcaacaaacgtttaattaaatgtgaagaaaggttacattctttgtgaatattataaagaaatcgccggggaatttatagaatatttaaaaatttagtgaatattaaccaaacgaactggaatttttgtcatttctcataacaaaaagcccaaaatattttgggcttttgctgtgtttcacgatcaaattaatcatcactgagtttatctttcgttttaccgacacccttttgcaggctgcctttcgctttgtcttttttcccttccgcttttaagtcggacttgtttgccatgtcgcctgctttgtcctttgcttcccctttcattttgttcatgccgccttttactttgtcttttaaaccgttatcttcactcatgatctcttcagctccttttgtttttgtgtacttgttttcttccctttcagcctgatagcaaacatttcaactctcaattattgatttcacagcgttccccgtagcggatcactttgtaaacggccaatccgtctgacagcttattatccccgtattgcacgggcagaagagcaaagaaaacataataagttgaaaaatagacaaattggtaaaaaaataagtttggctctaggaaatcttttatgatcagcagatttattaaaaagatagaagcgagattaaacagacagcctccggaatagacgagcgcgctcgtcagacggttatctatccgcaattcgccgaacttgcagaaagaatctatgaagtagatacgccgaacctgaatcggccctacttttaaaagacgtttccccattccgatatccaacgacgccttgcctccgaacagcatggccataaagctgtgtcccgacacatggatgacagacaccatcgggagaatgatgagaaatgaaacgaaaaactttatcatatcattaaatccgaacaacaaatccctccttcccatcgtacttttttccctcttttgcgatttttccgattttttctatgatcaaacgtcctgatgtgcataaaaaaataaccatctgctgatcagatggttaagaaaaattatatatcgtataaacactgttctttttgaatgttttctctcatgcgaatcgctttttcataaaaatacgccgcttctttatattgctcatgtgcgcttgtgtaaacggcggcctccaaggcgaaatcttcaatatacacatacagcgatttttcattcatatagtcaaacacttcatggattaaatccatattgagtgactccaaataaagcgcttgtaaaaacttatacttctctaaactgaatcggtcgccgcgttctttcgcgatcatgatccctctttcataataggtaagggccgcttggtcatcatgcagcctgaaaagggtgtgcgttaagctgaacagcgccttcggaagctgttcaagctgatgctcttcaaaaacgggaaccgcttttctaaagtaccgggccgcttcatccagatcccgcttttcagcataacaattccccagattgtaaagcgaagacccgatcaggcggggctgtccttcaagcaaagaaaggcggagggcttcgtctaaatgctcaagcgctttgtcgtagtttttgcagtcgatgtagtttcctgaaatgacgaaatggcattgaattctccgcactctgtaaaaatcgtgtttcatatacgtatccagcgcctgaatcccgtgattcatggaaaaatgagtctgcttcatgacgtaaaacacttcagacatcttgaaatggaattccgccctctctatatcatcctcgacaaatgaaaggagtttttccgctttccggtaaaaagaaatagccgcaacatagttattgtgatcgaattcatacatccctctgaacaaatggaaataatactcagacagtcccgatatgctgtccgtgctttcgatcgtcttttgcagctcgctgtactgaatctgtgattgttcggtgcattccggcttgacgtaatcaagcataatatgatggcggtagctgatcagctgataatataacagcagcagctggtcttcctccatacgttgtatatcctcatcaatttcctctttcagctttatggcatcagccgcttgaaacgctaaaatgtgcttgtaccatttgttgatcttgactccaacttgagatgacggaatctcgtatgcggtcatgcccctttcacaaccttttctaatttctattggttatattttaacatattgtatggctttggaattgcataacttgattgtcctgcatcaaaattcctatcatatatttcggctgttaccggtattttttgaacagaccgctctcatattgtgaataaaaaagcctgcccttgtccgggcaagcttttcttcatccgcctatataagacatttccactttcttttttccatccgttttagaaagcgcgcggtcaattgaatactgatccgtgcgatttctccagacagaagcgatggattccgtcaattcatcatcggtcagaccgccgcgcacgagtttccgaacatcatagccgcttgacgcaaacaggcacgtaaacagctcgcctctcgccgacaggcgcgctctgttgcaggaggcgcagaatgcatccgagacggaggaaatcacgccgatttcgccggaaccgtcaagatagcggaacctggaagcgacctctcctttgtaattcgcttctatcggctccgtcggcatgtgctggttgatcagatcaataatttcggccttcgtgatcacgtcttttttattccattgattcgtattgcctacatccataaattcaataaaccggagaatatgacccttttctttaaaatagcgggccatcggcaggatatctttttcattgacgcccttttgaacaaccatattgattttcacaccgagtccggccgcttttgccgcctcaatgccctcaagcaccttgttcaccgaaacgccgcggccgttaatggccttaaaccgctcatcctctaaagaatcgaggctgactgtcactcgatgcagccccgcctgcttcagtttttccgcgtacacgggaagcagagagccgtttgtcgtcatcgcgatatctttaagtccggggatgcgcgcaagttttttgatcaattcaggcatatcttttctcatgagcggctctccgcctgtcagcctgattttttcaacgccgaagcggccgacaaacagcttcgcaagccgctcaagctcctcgaaggagagcaattccgtcttttgtaaaaatggataatccggtccgaataattcggctggcatacagtacgtgcatctgaagttgcagcggtcggttacagagatacgaagatccctgagcggcctttcctttttgtctgtcacccggcgcgtttctgtattcataagcccaagacccctttctattgttcaacccgttcaggatgtgtgtatacgttaaatgatccgtttctgacaaaaccgatcgcggtgatgttcagctcttccgccatttgcagcgcgagctccgtcggcgccgattttgaaatgacaatcgacacgccgatttttgcggcttttaataaaacctctgaggaaatccggccgctgaagacgatcagcttgtcacggacgggcattccgtttttcaaacagcagccgtacagcttatccagcgcgttgtggcgcccgatatccgtcctcatcaagagcagcttttccgtatcgcacagcgctgcattatggacgccgcccgtttcccggaaggtgccgcttccgctttgcatctccttcatcaggcgaaggcacgtctcaggagttatggtaatccggctgacggcggttttggccgttttcacatcctgctgaaagtaaaaatggcggcctttcccgcagcatgaaccgatgaccctcttcgtatagtctttttgctcaagcactccgggattcgtcagttcaacatatgcgaacccgagactttcatctatagtaaagcttttgatctctttttcaaaacgaatgacgccttctgatgcgagaaatccgatgacgagttcctctaaatggtcaggcgtgcagacgagcgtaacaaattcctgcccgttcaccatgacggtaagcggatactctgaaaccatccgatctgccgtctttgttaatacccctttttcatagcggtatatgtctcttaccgctgttgttttttcatccactgttttcccctccgcagtatccttctcttttattcttccacaatccctgtattttgtcgaatttgcggtttaaaaaaagagccctcttcggactctatgtttcattgcgatgatgtctgctcagaatggtgaataaaataactgcggcgataatggccaatatactgacgaatatgaaggcggcaagcttcagaaaaatccctatcagaacaaaaacgactgccgccagcaccaatataatgcctgctccttttaacaacagcgttcatctccttttatccgtatcattcccgcggttccgttttctaaacaaaaaaagacgccgcacgggcgtccttttttaacctattcttttgctaaatcctttgcggcgtcttcccaagcctgtttgaactcgtccgcgctgtcagctgagacgtatgtgccgcctcccgcttccgccgctttttcaaggctttcgcttcctttcatgccgaagttgaagccgatgatattgacgaccgtgttgacattcgctttacggagcttttgaatttcggcttgaggattcccgccgcatgtttcttcaccgtctgtgatcagatatacgacgtttttccctttagcgccggcccgctcaaattcttcacgtgtatcagaaagcgctttcgctatcggtgtccagccggttggtttaatcttgctgagtgattgctcaaatggagtcacggcgtacggctgaaggccgtataacgtttctgtcgcgttacatgatacggctttgcctgagtttttattattgcccttatgcccgaatacccgaagcatcagattcgtgtcttcaggaagaacttccgcaaaagaagtgacagactctttcgcaacatctattttacgctctccccctgttttttgtatcatgctcccgcttgcgtcaaacagcacggcgacgtttgtttcttcgtgctttttctcagctgcaaaaacaggtgatccgagtgaaagcgtcaaaagtccgacaatccccgcagtgaacatttttttcatttccttcattcctctccgtttgtttttggccgatgggcccccggctcttctctatgctagatgaggagtatgcaaaaagatatagggcgggattccttttgtataagcggctgtacgccgttaaaaatgaacagaattatgcgcatcatcctaaaaagattggataaatgatgacagatttaatgcctttttcgccctttttgtaatataagtccggaatctgattctttttacagttttctcttcatcttttcttgaaatttttgttaaataaaaataaaaaaaagggccgctaaacggcaccttttcttatttcgctaatgaactcgcttccatcgtaaagatgcggttcatatccttttggctgtgagcttcgtaatattttcctccgcccgcaccggcaattgcgtgaagctgtccgttgaagccttctttaaagtcaaagccgattacgttgactttaatatgatgtttgcgaagttctttcgctgtcttaataggatctccgccgcatgtctcctcaccgtccgtcaacaggtaaacggatttaaagccgaatttatgaacgccgttaaaagaagccttcgcatcttctaatgcttttgcaatcggtgtccagcccgtaggcccgattccgttcagagagttgaggaagctctgtctgtcaaacttttggaatccgtatacaccgcgaatggattcacaagattgaacttttccggagtttttattattgccttccgaaccgaaaaccgtcattctgacctgtgatgtagacttaattcgatctgcaaaacggacgatttcatcttttgccatattgtatttagaaacgccgtcaatccgtttcgccatactgccgctcgcatcaagcaaaatggcgatattgtttttaaataaaaatgtcttctcgtttgcattctcggcagcaaaagcaggagatgcagcagtcagcatcaatccgagcatgattatgagtgaaagtgtttttttcattgcttcttccccttttcaatagatttacgttcaacgccgaacaacatttatcgtaaatgagatgaaaagggaaataaataggacggcgttcctcattatttttgcgtatattcacatagatacggcatttttatcagtgattttcacccggcgctcagccttcagacggcatttgtcagcctttaggctttcgttatatgagtctgttggttgctttaccgtttatggaatagttttcaaaaaaacagacgctcatgaaagcgtctattttttcgccatatatttgtttaaaaatgaatctgcttcggatatgtccactccctgataataatgcttgacgatgtccgccacggatttcccctgctccgccatgtaattggccccgtactggctcatgccgacgccgtggccgaatccttttgtcgtaatggtgatgctgccgccgttccgtttccattcaaagtcggcagaacggagtccgagtttttcccggatgtctcttcccttcagctttttgccgtttatgacggccgtcgccacttgatggcccggcgttctggctgtaatctgccctaccgtgttttgtcccgagagctgtacgccgagcttttgctgaaactccggcacactgaaggtctgggtggcgagatatttcggcgaatgcttatcccacggacttttcacgctctttaaataaggaatggcgcttgtccaataggcttccgcattttccgtatacccgttgctcgtagagaagaaagatgcctcaatcggcttgttgtcgtacgttaaaatctttccttgcgtgcctgcgaccgcgtttgtgattttcttgaggttgtgtgcgtacttagaaccccattcttttttcagctgacttttgctttgatagacttggaacatttgcgtatcgtccaccagtgatcctttcggcgcctgaacggctgagtcagcgaccatcagcctgacgatgaaggtccgggcggcgagcgcctgggcttttaaggcttccggtttaaaggttgcgggcatttcggaagccacgacaccgatcacgtactcttcaagcggaatgttctctacagaatgattggatgtccgataaaccggaatggatacaggtgattctttcaatgtttctgctccttttgtttctcgtgtggtgtgtgttgttttgtgtccgggctctctgtttacggctgctcctttttccgcctgaaacggaagaacgagaatggtgggaacaagaagaataagtatacacagcccggatagtagaaatacaatcggtttcatatatcagctgcctcctgcttgggattcgactctacttcatcttatgggcagggacaagctaatatgacttccttttggacagaatcttattccatttttcacgcgaaaaacgtattcttttttgaaaatcagagcataataatgatgataaaccataaaaaaacagtatgccagattgacatactgtttttacagccattatgcgtttaggtcagttacgacttctttgctttcttgttcagcggccgtttcatcaacgacacgctcgatgtcagcgccgagagccgcaagttttttatggaaattcacataaccgcgatccaagtgcttcagttccgtgacgcgtgtatgaccttcagccactaatcccgcaagaatcagcgccgcgcccgcacgcaggtccgtagcggcaacttctgcgccttgcagctgtacaggaccgttaatgatcacagaacgtccttcaattttaatgtcgccattcatccggcggaattcttcagcatgcataaaacggttttcaaacacagtttcagtaatcatgcttgttccgctcgcacggagaagcagcgccatcatttgcgactgcatatcagtcgggaatcctgggtgaggcatcgttttaatgtcgatcggcttcagctgggcaggaccgatgacacgaaggccttctccttcatccgtaattttgactcccatttcttccattttcgcaattaaagacgtaagatgctcaggaaccgcacctttgactaatacatttccttccgtgatagccgcagccaccatgaaagtacccgcttcaatacggtcaggaatgatgttgtgtcttacgccgcgaagcttctcgacaccttcaattttaatggtgcctgtgccggctccgcggatttttccgcccatcgcattgatatagttcgctaagtcaacgatttcaggctcttttgccacgttttcaagcgttgttgttccttcagctaaagcagctgccataatcaagttttctgtcgcacccacacttgggaaatctaaatagatttttgcgccctgcagacggccttccacttctgcttcaataaagccgttgcctactttgatttttgcacccattgcttcaaagccttttaaatgctgatcaatcggtcttgagccgattgcgcaaccgcccggaagcgctactcttgaatgacccgtacgagctaacagagggcccataacaagcactgacgcgcgcattttgcgcacatattcaaaaggtgcttctgtttctaaagcgtaagaagcgtttacggtaacttcattattctcaaaatgcacatctgctcctaaatgacgcaacacttcattaattgtatatacatcggagagcgtaggtacatcacatattacgcttttttcttcacttgctaataaagatgcagcgataactggtaaaacggcattttttgctccttcaactttcactgtgccgtttaacttctgaccgccgcggacgatgattttttccaaggtattcccctccgcgtccctatattctctatattaatattcagttgtcacgattggtgtgccaaccgtaacggtatgttttccgcccattcccgcacttctaagcgcaacttgcacattcatcttatgtttcgatgtcatgatgtaatctgtccacttatatgtaaatgcagaaacagaaacgaaatgaggctcaactacatgttcaactggacttgcttcaaattctttcatgagctgttctgcttttttttgcaaaacaatactcatattatcatttaaatgaccctttagacaagtaaaaataaatactttattttgaaatatgtcatgtgcctgccgttcaaactgttcatatgtatcattccagttttccggttgctccgggctcatttgctcatataataaatacgaagttgggttctggtttttgagggtagtgacgagctgcagtttaaaagttgtgtgattttttttgtcagaatacgtgccgacggcctttacgattttatcttcccgcgcggattcccaatgatattgcggatactgcgtcttcagttcttttaccttgtcatcaaattcactcagtgacaggttcagattttttttcgcatgaagcgtccattcatccacagtgacctgctgccgctccattccttcggcaatctgggcaagcggagacagctcacttgcatgaatggaatgaaataccgctattaaggcgcttaaaaaaacaaaaaacaagatgatacggcctgctctttttttcttcatatcgatctctcccccttactcccatttttgccggagccggggaaagcaatacatggaaaacttcgtcaaaactcgccaagcgggtgaagaaaaattggtttctcacccagcgattcccttcatttcaacagacgaaacatcttaaaataagtatggaagctgtttcgaataggtaagataatctaaaaagaagttggcgactgccgtaccgatcgcaatggtaagaagaatgatcagcagcctcgcctgcactatttttccttttcggatcagcggatcaaagttgacggcctgaagcgcccaccatgtcaccgcaatgcataccaggtgaaccaggatgctgattgcggcctgctgccccaatacattcacaaattccatctcctttcattttttccgcccctcatatcctctcttattatataagaagaagagagaaagatgatcatttttacatcagaatttttatccaaaattaggggcaatccccgcttaaatgtccgttctccggcatgatatacttttttggaaaggagatgggaatatgaatcattccttttttcatccggaaaagcagtatggagaaacacttcccgtatttgaccacgagtgggaagcgatagcattctactatgattatagacagtctcaaacagaggaactgaaagaattatgtcagtttttcaacatttctcttgattattcacccggcagcctgctggcagtggaagctctttacttccgcagcataaaagagctgcttttggcggattggaacctgccgattgacgaatttgagaaaatgctcagtgtgtatgtcatcgattgcgccatcagacatcatgacgatgccgaatgggtcgtcaaaccttatccgtatacggacggtgcttatacgacgggtgtgcggagaggaaacaaaacgtggcacaccgacaactgctgcgaacatttatatctgcaaaaagaagaggatcatccgcttatcggcgtctatgaatctcttatgcgttaatatagaaaaagaatccttctcagacagccgagaaggattcttttttagtttcctgcaacatccaatctgtttacagcccgctgtaacgcaagctcagcccgacgaatgtcagtatcatctgatcgtttgttcaaacggtcttccgcccgctttttcgcagcaagggcgcgctctttatcaatgctttccgctgtttcagcggcttgtgcaaggatagtgacctgatcaggacggacttctaaaaatccgccgctgacagccgccaattcggtctgcccgtcttttttaaggcggacagcgccgattttaagcggagccacggtcggaatatggccaggcaggataccgagatcaccgctctcggctcttacactcaccatttcaatatcagcatcatatactgggccgtcgggagtaacgatattgactttaacggtcttcatgcttttaccctcctaggaccagattaaacttctacacccatctcttttgcattctcaatgacttcttcaatgcgtcccacaagacggaatgcatcttccggaagatggtcatatttaccggaaaggatttctttaaagcctcgtaccgtttctttaacaggcacgtaagaacccttttgtcccgtaaactgctcagctacgtggaagttttgagaaaggaagaactggatacggcgtgcgcggtgaacgacaagcttgtcttcttcacctaattcgtccataccgagaatcgcgataatatcctgaagttctttgtaacgctgaagcgttgactgaacttcacgcgccaccgcataatgctcttctccgacaatttccggagcaagcgcgcgggaagtggaagccagcggatcaaccgcagggtagatacccatttcagttaatttacgctcaaggttagtcgttgcatccaagtgagcgaacgttgtcgccggagccgggtcagtgtagtcatcggcaggcacgtagatcgcctggatagatgtaactgaaccaacgtttgtagacgtaatacgctcttgaagctgacccatttctgtcgcaagcgtcggctgataaccaaccgcagaaggcatacggccgagaagcgcggaaacctctgaacccgcttgtgtgaaacggaaaatgttatcgataaagaacagtacgtcctgtccttgtttatcacggaaatgctcagccattgtaagacccgtcagtgctacacgcatacgtgcgcccggcggctcgttcatctgtccgaagaccatggctgttttcttgataacgcctgaatcgctcatttcgtagaaaaggtcgttcccttcacgagtacgctctcctacaccggcgaatacggaaataccgccgtgctcttgcgcgatgttgttgattaattcctggattaatacggttttacctacgccggcgccgccgaacaatccgattttaccgcccttgatgtaaggagcgagcaggtcaacaaccttaattcccgtttcaagaatttcaacctcagttgaaagctcatcgaatgaaggagctgatctgtggatcgggtccttttgagcatccgcaggcagcggttcatttaaatcaattttatctcccagtacgttaaatacgcgtccgagagtcacatcaccgactggaacggaaatcggcgcacctgtatcaacggcttccattccgcgctgaattccgtccgtagatgccatggcaattgtacggactgtatcatcgcctaaatgaagagcaacctctagcgttaggtcgatgcctacttcattttcgcctgtagctggctgtgaaactttaatcgcattataaatcgcaggcaagtggccgtcctcgaaacgtacgtcgacaaccggtccaagcacctgacttacgcgtcctttcttcatcgctatccctcctgacaaaatctttctattctaaagcggctgcaccgccgacaatttcggtaatttcttgtgtaatcgccgcttgacgcgcgcggttatatgaaagcgaaagtgaatcaatgagttctttcgcattatcagtcgcatttttcattgctgtcattctcgcagcgtgttcacttgctttactgtcaagaagcgcgccgtaaattaagctttccgcatattgaggaagcagcacttcgagcacctcttcttcatccggttcgaactcgtaagaagccgtgcgcttcccgccgctcgttccgaaatccgttaaaggcagcacttttttctccgtcacttcctgtgaaatcgcactgacgaaatggttatacaccaaatgcagttcatcaaaagcgccgtcgataaacatttgaaccgtctgacgggtcaaatctttaatctgagcaaaagtgacctcgtcgccaagccccactaactcagacaaaatcggcatctcccgttttttgaagaaatcgcggccgactctgccgattgcaatcaccgtgtattcatctttagactgatggcgttcttgaatggtgcggtaagcgtttcgcaaaaccgaactgttaaacgcacccgcaagcccgcggtcagacgtaatgacgagatacgccgtctttttcacttctcttgagacaagcatcgggtgtttcgcgtttttcgcgccttttccgacgttaaacacaacctcctggatcttatccatatacggagcaaatgacttcgcgttggtttccgcacggttcagcttcgcagcggataccatctgcatggcttttgtaatctggcttgtttttttcgttgacgtgatccttgacttaatatcgcgtaatgaggccaaagatttcaccacctttattcttcatttgcgtaaaaagagagaaaaagagaacctttttctctcatcttctaagggttagttgcttggtgcaaatgtgcgtttgaagccttcgattgcagctttgaagtcttcatcagcaggaaggtttcctgttttcgcaatgccgtcaagcagatctttatggttttgatcaaggtacatgtagtactcttcttcaaaacgtctgatatccgcaaccggaatatcatcaagatatccttttgtcagcgcataaagaatggctacctgtttttcaaccggaagcggcttattcaagtcttgcttcagcacttcaactgtacgcgcaccgcggttcagtttcgcctgagtcgcctggtcaagatcagatccgaattgggcgaatgcttcaagttcacggtatgaagcaaggtcaagacgcaatgttcccgctacctttttcatcgctttgatttgggctgacccgccgacacgggatacggataatccggcattgatcgcaggacgcacgcctgagaagaatagatcggattgaaggaaaatctgtccgtcagtaatggaaatgacgtttgtcgggatataagcggagatatctcctgcttgtgtttcgacgaacggcagcgccgtaattgatcctgcgcctttagcgtcactcagcttggctgcgcgctcaagcagacgggagtgaagatagaatacatccccagggaatgcttcacggcccggcggacggcgaagaagcaatgacagctcacggtaagcggccgcttgtttggataaatcatcatatacgacgagaacgtgcttgccgttgtacatgaattcttcacccattgtcacccctgcatacggtgcaaggtaaagaagcggagccggctgtgaagcggatgccgtcacgacaatcgtgtaatcaagcgcgccgtgcttacgaagtgtttccaccacgccgcgtactgtagattctttttggccgatcgctacgtacacacagatcatgtcttgatctttttggtttaagattgtatcaatcgcaacagatgttttacctgtctgacggtccccgataatcagctcacgctgtccgcggccgatcggaattaacgcgtcgatcgctttgatacccgtttgcagcggctcatgtaccgatttacggtccattacgcctggagcctggctttcgatcggacgtgttttgcttgtcagaatcggacccagtccgtctaccggctgtccgagcgggttgacgatacgtccgattaattcttcacctacaggaacttccatgatgcggcccgttcttttgacctcatcaccttcgcggatatctctgtaaggtcctaagataacgatacctacgttggattcttcaaggttttgagccatacccaaaacgccgtttgaaaactcaacaagttcaccggccatacaattgtcaaggccgtgtacacgcgcaataccgtctccgacttggatgactgtacctacgtcatgaacttcaatttcagattggtaattttgaatttgctgctttatcagcgtgctaatctcttcagctttgatgctcacttaggtttcaccccttctatcgatttcctccggcaagttgacgttccatgcgctcaagctttccgcttacgcttccgtcataaatccggtttccaatgcggactttaatgccgcctattaaatccgtctgcacttcatttctgattctgagcgaagcgattccggctttttttgcaaacacttgagacaatgataacatttccgcttctgacagcggttttactgaataaacaaccgcatcctctgtctgacgggcctgattggcaagtttgataaactcgtctgtgagatcaggcacaatcgaagaccggcggcggtcaatcagaagaaaaatcgtatgcagcacagactcagacagtgcgccgaacgattgctgaatcagctcttttttcttagcggccgataccttcggatggcttagcacttcctgtaatccggcttcgttccggaacacttcttttagtacggtaagctcttcttcgatttcattgatttgagaagtctcaacggcaatgtcgaaaagcgctgacgcgtatcgtttagagacagcagatccactcatcggctttctcctacctctttaagatagtcctgaatcagttgttcctgggcttgttcatcaagctctttttcaatcactttcgatgcgattaagacagaaagtgatgcgacttgctcgcgaagtgcggaaaccgcttgttctttttctttgacaatttcggttctcgccgcttctttcaatctttcagactcggcgcgtgcagcctggataatgtcttccttctgcttttcacccagttttttcgcattttcaatgagtaattgtgattcctgtttcgcttcttttaaaagaacgcgctgctcttcaatcagcttctgcgcttctttatttctttcttcagcggacgtaatttcgccggcgatatgatcttcacgctgtttcattatatttaatagcggtcccagagcgaatttcttgagaagcgctaataaaactaacatagctaacaattggaataggatatctccgccgttaaacgacagtcctaattcaagaggtaattgagacatctactacggcaactcccttctgcaggttttctctgctgataaaaagccgtttcgggacggcctgcttatcagacataaagcaatggcgaaggttctcttagagtgatcttcgccatttttagttcatataaggcttttttgcttagccaaagaacgctaagaacgcgataacgacagcgataatcggaagggcctcaaccaatgcgatacccatgaacataagagttctaagttcttttcctgcttccggctgacgggcgattccctctaccgtacgtgaaacgatcagaccgttaccaatacctgcaccaagtgcacctaaaccgattgcaattgcagctgctattaaattcatgaaaaagttcctcctttaaaatgttatccgaatggatatatgattttaatgatcatgactgattttgtgtgacatgtacaccatcgtcagcatcgtaaagataaatgcctggatggtaccgatgaacaagctgaatgcctgccatgcaagcatcggaataatggctccgactgtgccgaccaaaccgagaaagaaactgtttgagtagaaattcgtcgccagattcgcaagcaggccaagaagaatttccccggcgaaaatgttaccgtaaagacgaagtccgagtgtcagcgtattcgcaaactcctcaatgatcttcatcgggaacataagcggaaccggtctgaggtaatccttagagtattccttcaaacctttcatcttcacgccgtaatagtgcgttaacgacacaaccataacggctagagtcagagtaatagccggatcggccgtcggtgatttccaccaaagctcgtgtccgaccgttacagaaaacggcagccctagcatatttgatacaaatatgtacatcagcaaggttacaccaagcgccaagaagttagcccctgtttttaaatccattgtactgcctataatattgcggacaaaatcaacaatccattccatgaagttctgggcttttcccggacggatggacagcgttcttgtagtaagaatcgcaatcagcagcacaatcacacttgccacagtaatcatcagaatgtttgtcagattaaaagtaagaccaaacaaatcaatagttctgtaatcgtgattcaatgggttttcacctctcttccattgatgaacgtttgagctgaataatggaatctatcataatgacgggataaattgtcattaatccaataatcacacttgccacactgactttatcgggatttttaaaggcgacagccatcgcaagtatcgcattgcaccaacgcgctgcgctcccgagtgatcgtatggactttcctttcgccacggccttgtcaaaagcattcattcttctggtcaagagccacaaattaaacaaactgaaaacagttcccaaaaagaggcctaaaaaaacagttttatacgccgtaagaccatatcccagcaaatagattgctaagattacaaatacatatctccgttgtctgctgaatgtaagattgggatcgtccatcaactatctgtctcctgatgaaaatgtaatataattcctggatacggcaaaacatgcggttaacccttgcagaaggccttttttgtccgcaaaacggcctgttcgaaaaaaccactcatcctcctgatgctacgggatgctgtttcattcgcttagataaatcctcatataacgggtttttttggaggatttaaaatgaggatggatactagaaatgaaaggaatgaaaaccttctcataataccctcgtttagcatacaatagcccctaacatgtgtcaatctgtttaaagttaaaaaactttttataccggaagcatacacagaatgttcacaaattcacctataaatgtatgaactctgcccattcagctaaaatctggataaaaaaaaagaaaaccccctgaatgaggttttccgatttatttggttccgtacagtctgtcacccgcgtcaccgaggcccggaacgatatagcctttttcattcagtttttcatcaagggcggcgatataaatatcaacgtcagaatgatgtttctgcagctcttccacgccttccggagccgctacaagacacataaaacgaatgtttctcgcgccgcgctttttcaggctgttgatcgcttccaccgcagagcctcccgtagcaagcatcggatccacgacaataaattcgcgttcttctacatcagaaggaagcttgacatagtattccaccggttttaaggtttccggatcacggtataatccgacatgtcccactttagcggccgggattaatttcagcatgccgtcaaccattccgagacccgctctcaggatcggcacgataccgagtttcttccctgaaatcactttggatgtcgctgtttgaacaggtgttttcacttccacttctttaagaggaagatcacgtgtaatttcaaacgccatcagtgatgcgacttcatccacaaggtctctgaaatcctttgtgcctgtattttcattccgaatatatgtcagcttatgctggattaaaggatgatcaaatacgtaaacctttcccatactgtgttcagctccttttttgttgtccgagtgactttttcacacttctattgattctacagaaaaagacaaacagtttcaagaaaatcataaaaaaacccgccggattaaggttccggcgggtttcttccttattaatagtccagttctttatataaaggaaacttttcagtcaaggcagatacgcgctgtttcgcttcttcaagttttgcttcgtcttcatgatttttcagcgcgaggccgatgatggcgccgacttcttcaagcgcgtcaccgtcaaagccgcggcttgtcacagccgccgtaccgagacggattccgcttgtgacgaacggtttttccggatcgtaagggatcgcgtttttattagatgtaatgccgatttcatcaagaacgtgttcagcgacttttccggtcagtccgagagaacggaggtcgacaagcacaaggtggttatccgttccgcctgatacgagctgaatgccctctttgttcagagactcagccaggcgcttcgcgttcgagatgacgttttgcgcatatgttttgaaatcatcttcaagcacttctccgaaagaaacggcttttgccgcgatgacatgcataagcggtccgccttggattcccgggaaaatggatttatcaatcttcttgccgaactcttcacggcaaaggatcattcctccgcggggtccgcgaagtgttttgtgagtcgttgtcgttacaaagtcagcgtaaggaaccggattcggatgaaggccggctgcgacaagacccgcgatatgcgccatgtctaccatgaagtaagcgccgacttcatcagcgatttcacggaattttttaaagtcgatcgtgcgggggtatgcgctcgctccggcaacgatgagtttcggcttatgcgccagcgctttttcacgcacatcttcataatctatatattgcgtgtctttatcgacaccgtattctacaaagttgtattgaacgccgctgaaattaaccgggcttccgtgtgttaagtggccgccgtgggagaggttcatcccgagcaccgtgtcgccgtgctctaaaatcgtgaagtaaacagccatgttcgcctgagcgcctgagtgcggctgaacgtttacatgctcagctccgaaaatctctttcgcccggtcgcgggcgatgtcctcaacgacatcaacatgctcacagccgccgtagtagcgtttgccggggtagccttcagcatatttgtttgttaaaacagagccttgtgcttccattaccgcttccgtcacgaagttttcagaagcaattaattcgatcttagtctgttgacgcttacgctcatctttgatggcgttaaacacttgtttatcttgtacaggtaaatgtttcatcagcgagatcctctcctatccgtttcctgttctttatttttaccaccttattgtacatggtttttcaggtgaatgtaacagcttatttaaaaaaatcacaaaatttaattagaaaacacgaacattatagaggaaaagtatttttatcattcgcattcataaacggcgcgaattccgcctatcagcttcggtcttgtccgggccatcgtcacatgtgcttctccaagctcacggctcgatatccggacagggacggcaacgggtttcagatgcatgccgatgaacgtatcaccgatgtcaatcccggcgtcagcctgaatcgattcaacgagcactggagaacgcatctgccggtatgcataagaggccatcgctccgcccgctttcgggacggggacggctgaaacaatggggagcctgaaccgctcggccgtttccgcttcaatgacaagcgccctgtttaaatgctcgcagcattgaaaagcaagatgcacacccgttttttccttaaaccggttaagtccgccgtatatcaattcagcccaatccccgcttccggcggtgccgatccggcttccggcggcttcacttgtactgcacccgatcaccagcagactgccgtccgtcagtcctgcctgctcttgaaactcagtcagcatgtccgtccatttttgcttcatctcttccattgtccagcacctcttacagatttttttcttcgtaatctgcgattttgccgatccgccgttcgtggcggccgcccgtaaattcagtcgtcagccagacttttgcgatttcgcgcgccagccccgggccgatgacgcgttcgcccatcgcaagaacattcgtgtcattgtgttcacgcgtcgcttttgcgctgaaggtgtcatgggcaagcgcacagcgtatgccctttaccttatttgcggagatgctcatgccgatgcctgtgccgcaaattaaaattcccctgtcagcttcgccgttcaccactttttccgctaccggaaaagcgtagtctgaataatcgacagagccggcgccgcattcacagcccatatcaatgtattcaatctgcaattcatccaaaagactttttatttcttcgcggatatggacgccgccgtgatctgacgcaatagctactttcattcatttacctcctaggtgtggctgggcgaagacagcccagtgtgcttgtcctttttattacgaaatccgttgatttcattctactctttcacattcgttttgcaaatgacctgtttgcagattttctgacagattacttgcttttcccgtcaagcaattgatcagccaaaagggttagcagctcctccagttcgtcccgcgtctgtttataaacatcaagcggaccgccgaaagggtcagagatatcgccgttttcccccgttacgtattctttaatggtaaagactttgccctgactgttttgatatcggccttcaatcagctgtttatgctgttcggtcatcgccagcaccagatcggccgtctcgatatgttcttccgataagggagatgaactgtgattgagggcgatccgtttttcaaacagcgcttctacggcatgagccgacgcttttccgtgcggagacgcgaatacgccggccgagcttacgctgacatccagccctttcgtttctgctatggatttaaaaagagcctcagccatgggactgcggcacgtattgcctgtacaaacaaagattattttcatgtccgtcacctcttactgcctattataaatgaagaaaaaagaaacggcatcttcgtttctttttttacgtatcttatatcggtaaaagcagtttcagcccgaatccgatcaaaatggctccgccaagcgcttcgctgtaggagccgagccatgactgcacctttcttcccgccaaaaggcccgcccatgttaaaacggtgctgaagaccccgaacagcgtaacggccagaaacggattggagccgttcatcccgagactgagcccgacagaaaagctgtccagactgacaccgaccgcaaacagcaacagtcccgagcctgccggagatatgagcggcccgtctgactgtttaaacgcggcgatcatcatctgcacccctaaaatgaaaagaagagatccgccgatgtaaacggcgagcatccccagaaaaccggacagcagatgcccggccgccattcccacaagcggcatcatgacatgaaacagcccgatgacaacccctatatgaaaaatctgttttttcttcagctgaatcattcccattccgagcccgacggaaaaggcatccgtccccaaagcaaatgccatgatgcttaaggagacaagttccccgatgaatagattcgacatgaataaaaacccccttggacgtgcccgcttgtttagcttatgcatgtccgataaggggtagaacaagttaatggataacggtgccgcctgcggctttcatcagcctgttcataacggcgagccccactccggtatccggaaaggactcagaaataatcatatccacttccgcttcatcaaagctgcggagcgcatcgtataaggcggacgccactgtttcaaggtcggcgcgtctgccgcagaccttgatataatcagcctggtaactatcggcgttctcttctgttgtcaaaatgccgattcgttttccccggcttttatatgcgtctgccagttcttgaattctccgggcgccgccgtcggcaatagccatcggcgcagaaggcgcgtaatgtgtatatttcataccgggagaaataggaacctcatcttcttcggtcagccctttatccacaagaaccggaccggcggcggattcaatctgctcttttgtcacgccgcccggacgaagcagcacgggctgtttccccgtacaggacagaacggttgattccactccgattcccgtcgcgccgccgtccacaataccggcaatacggccgtttaaatcatgagctacatgctcggccttcgtcgggctcggttttcctgataaattggcgctcggcgcggcgatcggcagtccggccgagctgatgagggctaatgctgccggatgatcaggcattctgaccgctaccgtctcaagtcccgcggtgacacggggtgacagcacaccgggcttacacggcaggacaagggtcagcgcccccggccagaatagctccataagctttttcgccgtctcaggaatatggctgataaaacgatcaagctggctgatatgggatatatgcacaatcagcgggttatcgctcggccttcctttcgcctcatatattttcgttacggcttccgtattttcagcgttagcgcccagtccgtaaacggtttctgtcggaaaagccacaacctcattctgccggagcaattccgcggcttgtgtaatttggggatcggttgtggataattctgcggaacaatccacaaaccatcttcttgttttcatgtataaccaaactccttattttaaagcggtaaaactttattttctctcgtgtattccttttgaaagtataaaagatgtcctttaataaaacaagcgttatccacaaactgtggacaacactttttaataagtggataaccttgtgtataagttagatcaggcagaggttttcaccattaaaaacgaaccttctgtgcataacgagttgcggaaatgttcggacgtatacagttcatcaggcgcatcggcgcacgcttcaaatcccatcacattcagaaactcagcagatgagggctgattggcgactaagtagacatcttgaatctcatgttttttgcacagcacatccatactttgaaacagtgtaacgatatggctttgattcagcctgtccgacatgacgagtgaacggagaagcccttttccgcctctgaatttttcgatcccgagacaggcggcaatctttttttcgctgtcttccagcacgataaaccggctgatctgctgatcgattttcgcatgtgccgtatcagactttttcaaaaaggcctccagcgcctccgtatcttgatctcttgccactctcagctgataaaacatatatttccctccgtttcgatcaactctttcttccaatctatgaatcgaatccggatttatgccttttgcttcaggaaaatagatctgaaatccaatcgacgaggaaaaacttcacttcggtatcatcgtcatctttattttctttcttcgctttatcagcctttgcttttacgtcatccagcactttttctgtctgtttctgcgtttcttcctgcttctgtccgccgtcttcctgatctttcaccgcttcgccgtttgagaaatcaaggaagcacagcggcggaaacaagacgcaccaccagttggcgccctcgccattgccgagtgtaattaaaatggcttcatattttccggccggatagaccatattgccgtacagctttgtcggaaacgagattttattgaattgaactgaaacggattgatgcgcacccttttctttcatcgtttgtttggcgatttctttaatttcaggaagcttcgaacgaatgagccgccgcgcttcttcaatggaagtgatatctttcacccagtctgtgatttgcttgtttacagcatctctgatctggcgcttgagcttttgatcttcatcgttatcactgttggccaaaattctgagccggatcgcttcatccggtatgacgacgggctcatcggctgatgcccgcgccgtttcttcttttgtcaaacccgcaagcgctcctgataataaaagaaaaatatatatgcagatcatcattgtctgtttcatcggtccccaccgttcctctccgtgcttttttttatctagtcccattatggacatgacggaaaaggtttaaaccggcgggaagaaaaaaatctagcaagctgataatctgcattgacagattcaaaatatggtacgatattattttgataggaggttttcagatgaaatataattacaccgtgctgctgtcggcggcatgtatgtctgtcatttattctattttgtatgttcatcaattcattatcgcggctttcatttcgatggcgttttattttttgtttccttatttgatttttgcgctgccgcttcaatactttctgaataaaaagccgaagagatttcatccgctgtattttctttattatttgggggtgtcgttcattgcaaacgggatcatcttcggtcttttgcagccgtcaggccaatctctgttttctaattcagccttttatatctttgcggttttaacagccgtcgtctattgggtatgggattccgtattgctgcaaagacaaaatccggctacagaagcgtaatcagcagacagccggctgaagggagagcggcgcaaaagaaaacggcggccatctttaaacgggcgcgccgtccttcttctgtttcagaatgataattggcccgctgctccgctccgcttacggccagcccggaaacgatgaccgctgcgacgataagaacagccgtaacggcgccgaaaatgatgtcaaagccaaacggcaggacaaatccagccgcataagctgcggcggcgagtatacatccgaaggcgaacgcttttttcaaggcggatgcccctttcattttctttccattgtaacaaaagcccgccgtgtgcgtcaccggcgggcttttttcatgatgtgatgaccgcggatacggttctgtcttttccgttgatgtcctgtacgacttccacttccgcattcggaaaggaatgacggaacaggtctttcacggcttttccctgattatatccgatttcaaagacgacaagcgctttatctttcatgacaagaggcagctcctccataaaccgcttgtagaatttcaaaccgtcaccgccgtccgtaagagcatgaagcggctcatggaaacggacgatatccgacaaatccgccatttcttcttcagaaatatacggcggattggaaacaataatatccgcttttattcctgatgaaataaaaggagttaacagatctccctgcaaaaagcggacgtccgctccaaggttttgcgcatttctttccgccacctgaagcgcttcttttgaaatgtccgaagccgatactgaaaaatgtccgcattcaagcgcgagcgtcaccgcaatggctccgctccccgtaccgatatcaatgacgttcaggcgttctccctcagaaaacacccgcttctgtctgtccagcagatgaaagacgacttcttccgtttccggacgcggaatgagaacatcgtcattcacaaagaattccctgccgtaaaactgttctttcccgataatatattgaatcggaacgccttctttatgcatttccacatgccgtctgaatcggtaaagctcgtcctcgccgacgggctcctgcagacttgcgagaagcttgctccgatccattccggtatcatttaacagcagcagctcggccgcgtttttttctcttcccgcttcggttaaataagaagaagcccagcttagggcttcaaaaacggtcttcatcttaattttccgcctgctggagcttgcttgactggtcttctacgattaacgcttcaaccacttcatcaagcttgccttccaggatttgatccagcttttgaatcgtcaggccgatacggtgatccgtcacacggttttgcgggaaattgtatgtgcggatacgctcggaacggtcgcctgatccgacggctgatttacgggtctgatcatattcagcctgagcttcctgctggaatttgtcatagattctggcgcggagcaccttcatcgctttttctttatttttaatctgagatttttcatcctgacaggatacgacgacaccggtcggtaaatgcgtcaggcgtacggccgacatcgtcgtatttacgctttgtccgcccggtccgcttgatgcgaatgtatcgacgcggatgtctttttcgtggatgtccacttctacttcttccgcttcaggaagacacgccaccgtcgccgtggatgtatgaatacggccgcctgattccgtttccggcacacgctgtacgcggtgcgcgccattttcatacttcagcttggagtatgcgccttttcccgtaatcataaagatgatttctttgtaaccgcccgttccggtcacgtttgcttccatgacttcagtcttccagccttggatttcagcgtaacgggagtacattctgtagagatttcccgcaaacagcgcggcttcttctcctcccgctgctccgcggatctccatgattacgtttttgtcatcgttcgggtctttcgggatgaggagcactttcaaacgctctgataaggtttccgtctctccctgcagttcggagatttcttccttcaccatttctctcatatcggcatcaagcttttcctcaagcatcgctttcgcatcggcaagctgttctgatgcgtctctgtattgtctatagacttcaacggtttcttgtatatcagattgctctttcgaatattctctaagctttttcggatcgttgaccacttccggatcacttaaaagctcatttaatttttcgtatcgttgttcaattgactgtaaacggtctaacacggtcttcacctctgttttcctgtgcgtaacattctcattatagtatagggcttatcaccagtcaaaagcaattcgcctctgttatactgaagcaaaaaaggaggggcggatatgctgaaatccatccaccatatagcaatcatatgctctgattatgaaaagtcgaaagctttttacaccgagatactcggttttggcattataaaagaaacataccgaaaggaacgggaatcttataaactcgatctggcgctggacggcgcgtatgcgattgaattgttttcctttcccgatccgcccgaacggccgaccagaccggaagccgcgggtctcaggcatctcgccttcaccgtaaacgatcttgaagcagccgtcagggagttaaaggaaaagggcgtcggcacagaaccgatcagaaccgatccgctgacggggaaacggtttacctttttcttcgatcccgacaagcttccgcttgaattgtatgaagcgtaacgttttttgaagaaatgccgctttctttggcgaattccttcttgttttgtctaacatgaagggaacgccgcctcatggtcgaatacctagcaaaaaggaggtatgtgatcatgaatacaaacatggccgcgaaagagctcggcgtctccgcaaaaacggtgcaaaggtgggtcaagcagctgaatcttccggctgaacggaatgagctcggacattattcctttacacctgaggatcttgatgtgctgaaatcggtcaaacggcaaatttctgaaggcactgcccttctggacgttcaagtgccccggcagccgaaaaaacggacgggcttcattttacagcgtccgaaaatcaatggcggcgctgaacaaaggttggcagagctggagcgtaaactggacattctcacgaaagagaaacaggatgagaaccatctgctttcaaggatagaggagcttgaacgccagctgaaacaaaaggcggatgaaggggtgtcttatcagcttcttcagcacagacgggaaattgacgacctcaataccgaattgcagacattggcctcccgcatccaggaacttgcccagacagctcccctctcagaaacagccgcttcttcagaacataagaaacccagaaaaaaaacgagattttcgccttttaaatttcaattctaatcaaaaaagctccctgaaacagggagcttttcattatgcagtcagcgcaatgatgatcggcagtgagataagagataaaatcgcactgatcacgaacgcggacgcagtttcttcctcttgtttttcgaaacgtgtggcaatcatcgccgctaccgcagatccagggaatgcgacgagcaataccgctttagtgatctggtcagccggaagtccgactgcaagagcgatcaagtacatcagcgcaggctgaacggcaacttttaacaaagcgataccgaaagccggcagactgagcttgatgttgcggataccgacagttacaccgacggcaaagagtgcaacacctgatgttgtgcttccgagctgatcaagcattttttcacccaagccagggagtgttacaccgcagagtaccaggatgatactgataagcggtgcagccgcaagcggttcggaaagaccgtgaagaatagacttaccagtcattttccagaagttctcgttttcgctgtcttgtttcttagatgactcaccgactgtagcgataatgatcgcaagcgggtcaaggatggcgttaaccacgatacccgtaacggcgataggaatcgctacttcgtttgctccgaataagcttccgagtaccggaatacccataaatgcaaatgtcggctgtgcagagtttaaagaaaatacagatgaattcgttaaatcatacttgaagataaatttgcaaaccaacaaaatgacgataaagaatccgacaatcccaatgatcaaagcgatcattaaaggaacctgtgataaaaacgcacttcttgaagtggttaaaatacttgcgataaaatgcgccggaagcgcgtacttcgtaactaaggtgcttaccccttttgctgacttcgcgtcataacttccgaagcgacctgcgaaccatcccagcacgatcacgaaaaagatcggcgccaggaggattaaaatatctaagaagctcaaaatattctcctccaaatccttaatgtccgtatactttagcctttacataaaagctttccctcggactgtaaaattaatcgtaaaaattatttagcgataacttgtttatattgcggtttccacattgcatcaagaacggcttgttctacattctcaggaatgcggtttgccacgccttctttaatggcagtttccgctacggcgatcgcaactttaattgaaacttcttgtaagtcgctcatgctcggcagaaggcctgcacccggtgtttcaaaatcaacgctttctgcgattgcgtcagcagttgccgcaaacattgcaggagtaatcactttcgcttctacaacgattgaaccgagaccaagtccagggaacgcgaatgcgttgttagattgtccgatttcatgagaaacgccattgtactctacattgtcaaacgggcttcctgtcgccacaagcactttgccgtcagtccatttgaatagatcgctaggaacggcttcagcaagcggtgtcgggttagacatcggcatgatgaccggacgctcaacgtgttttgccatttctttgacgatttcttcactgaacgcgccgctttggcctgatgtaccgattaagattgtcggtttcgcttgacggatcacttcaatgaaaggaatttgtccgttttcatcgcgtttccaatctttaatttcttcagctgtgcgcaggtacggctcttggaaatcaagaatgttttccataccttcaattaacaagcctctgtagtccattgtgtagaacgctttgttggcttcttcttcagaaagaccggcaagcaccatagtgtcgcggatttggtcagcgattccgattccggcagatcccgcaccgaagacaaccacacgctggtctttaatagacgcgcctgttttcttcatagccgcaagcacacctgcaagcgtaatcgcgcctgttccttgaatgtcatcgttgaatgtaagaatttcatggttgtatttcttcatgatattgcgcgcatttttgtttccaaggtcttcccagtgaagaagagctttagggaaatatttaagcgcagcttttacataagcgtcaatgaaagcttcataacgttcgccttggatacgttcatggcggttaccgatgtataaaggatcgttcagaagtttttcgttgttcgtaccgacgtcaagaacgacaggaataacacggcttgggtcaataccggcagcagctgtgtatacggctaatttaccgatggcgatgttgataccgcctacaccccagtcaccgattccgaggatgctttctgagtctgtcgcaacgatcagatcaatatctccggcagtggcatgaaggttttcaaatgcctcttcgattccttctacattgtcgatagaaaggtaaatcccttgaggtcttctgtactcatggctgtattcttgaatcgcttcaccgacagtcggtgtgtaaacaaccggcagcatttcacgaagatggttttgaagcaatttaaagaaaagaacttcgttacggttttgcaaatcattcaaatacacgttttggcgaaggcggtccggctgagcttgaaactgctcgtatgcgcgttttgcctgctcatcaagagacagaatggtcggaggaagcagcccgtctaatccaaggctttttctttcttctgctgaaaacgcaacacctttatttaaagtagggatagatagaacttcttttcctcttaaagtagtttctaagttgccttccttcgttactttaatattattcaagaaaatctccttctttcttcaaatagttaacaaagttaagtaattacccattttggctagtgtgatcgcgatctgctatatctttttttgacaattattcgaacaatgtctcataactatttacattacttagtcattttatgcctgtaaaaatgaaaattcaagagatgaaaattacttaattttttcatactcttttttaagttaattaactacaatttttgaaaaaccgtcaaaaaaacaccggattttttaccgatgttttcatgaaaagggttatttatcagtctgttttttcggcacttcgtggtgatgtctgcatctcgcttcgtatgactccgacgcgccgactaaaatgaccggatcatcataggaagcgggcttcccgtcaatcaaacgctgcgtacggcttgccggcgacccgcaaacggagcagaccgcctgcagcttcgtcaccgattcggcaaccgccatcagattcggcaccacaccgaacggctctccccggaaatccatatcaagtccggccgcgatgacacgatagcctttatccgcaagcaaggataaatcgccgatgattgattcgccgaaaaactgcacttcatctaccgcgatgacgtccgtgctttcactgatatgatcccatatttcagccgaagacgagatgacgtggcttgtcatggatgtgccgttgtgagaaacgacagcctcctcactgtagcgattatcaatggcaggtttgaacaccttgacctcctgcttcgcatatgtcgctcttttcactctgcggatcagctcttctgatttcccagagaacatgctgccgcatatcagctcaagccatccgctttgcttcattatgtacataggctatccgctcccctttttttcctgtttatggacataaaaaacaggcaagaagcaattcttgcctgcctgtaaaatctattattacttaagaccgtattttttgttaaagcgatcaacacgaccatcagcagaagcgaatttttgacgtccagtgtagaatgggtggcattcagagcaaatctcaacgcgtacctcttcttttactgagcctgtttcaaattcatttccgcaagcgcatttaactgttgcttttttgaaattaggatgaattcctgctttcattgtatccatctccttccgccctgaatcccgtgtggaaacagagttattattccggagcgaatccggaacgcatatgagagaattatatcagtcatttactgcatttgcaaatacattttttatcagcggcgggctgatgatgaaaggtttgcctgcttccattcttggttgatcagatcgaagaattcctgattcgtttttgtttttttcatttttctcataaacttctctgcgaagtccggagaatcagacatcgatttgcggatcgcccatagacggtcaagatgctctttcggcacgagcagctcttccttccgcgtgccggagcggcggatatcgatcgccgggaaaatccgtctttccgcaagagaacggtcaaggtgaagctccatgttgcccgttcctttaaactcttcatagatgacgtcatccatccgggagcccgtgtctacgagcgccgtcgccaaaatggtcaggctgccgccctcttcaatgtttctcgcggcaccgaaaaagcgcttcggacgatggaacgcagccgggtcaattccgccggaaagcgtacgtccgcttggcgggataacgaggttgtaggcccgtgccaggcgggtaatgctgtccatcagaatgataacgtcttttttgtgttcaacgagacgcatcgcccgttcaagcacaagctccgctaccttaatgtgattttccggcacttcatcgaacgtcgagctgacgacatcgcccgctacggaacgttcaatatccgttacttcttccggtctttcatcaattaagagcacgatcaattcagcgtcaggctgatttgtcgtaatgctgttagcgatttcttttaacagcatggttttaccggctttcggcggcgccacgatcagaccgcgctggccgaaaccgacgggagccatcatatcgagaattcttgttgagagatagttcggtttcgtctcaagcaccatttggcggtccggataaagcggagtcagcgcaggaaaatgaacgcgctctttcgcagattccggatcgtctccatttaccgcttcaacgtgcaaaagtccgtaatagcgttcgttttctttcggcggacgcaccttgccggatactttgtcaccgtttcttaaatcaaagcggcggatctgggaagcagaaatgtagatgtcttctgagcttggcgagtaattaatcggtctgaggaagccgaatccttccgattggatgatttcgagcacgccttccataaacagaagatcctcctgctcggcgttggctttcaggatggcaaagattaattcttttttagtcagtttgctgtagtaggagattttataatgtctggccagttcatatagttcttttaatttcatattttccaaagaggaaatagatacgtctttcataaaaacaccacgcttttcatagtcaatgtattgctgttttcattcaaatcggctgcttcgcatgattccgccaaagcacattcttttataaaacgttcaggaacttctatcggtaacacttccacccatgatcggcgcttttttaaaaaaggaatgtcttaatgagttttgaaggaagcgaggacaaaaacttgagaagatcaatatttatatcgtctgtatgcggtagaatttgaaaatttcccagtactcaaaagaaggaatgacacagaaaaatcgcagcactctttatttttacctcatttcaaaaaattattcaacttaaataatgctttgacatataaatgatagggttgactcttttttgcaaaagaaaagcgggactttccgtcccgcttttctctatttatggccggatcacaagatttggttttttcttcaggctgtgtcttccgtcaacgaatcggaccgttcctgatttcgcccggatgaccaggctttcagtcgtgccgacggagcctttgaactgaacgcctttcagcagctctccgtccgtgacgcccgttgcggcaaaaatggcgtcatcccctctcacaaggtcctccatccggagcactttggatacatcaaggcccattcgctcacagcgggcctgctcttccgcactttgcggcagaagcctgccgatgatttcgccgccgagcgcttttaacgcaacggcagacagcacgccttcaggagccccgcctgaaccgaagagaatgtctactcccgtatggtcaaaggccgtattgatggcgcccgcgacatcaccgtcgttgatcagtttgattctggcgcccgcctcacgcaattcagagatgattttttcgtgtctgtcacgatttaaaatggttgccacgacatcttcaatgtctttgtttttcgctttcgcaacggcttttaagttatcaatgacaggcgcttcgatatcgatgcagcctaccgcttcgggaccgaccgcgattttttccatatacatatccggggcgttcagcaatgttccatggtcggcgaccgcgatcaccgtcagcgcattccagccgccgctcgctacgatgtttgtgccttcaagaggatcgacggcgacatcgacgcgcgggccgtatccgtttccgagcttttcgccgatgtaaagcatcggcgcttcatccatctcgccttccccgatcacgaccgtgcctttcatcggcaccgtgtcaaacacgtcacgcattgcgcttgtcgccgcatcatcagcttcatcttttttcccgcggcccatccatctggcagatgctaaagccgccgcttcagtgactcgaaccaattccatcgataagcttctttccatttcaacacgatctcctctcaaaagtccgcatttctatgaattttggagctgttctatctcttcgtccgtcagcctttgccgccagattgtggcgcccagaccttcgagttttttctcaagattgctgtagcctcggtctaaatgctcaagaccggtaatttcggttacgccgtcagccatgagcccggcgacgaccagacaagcgcctgcacgcagatcgctcgcctttacttttgcgccctgaagctcggcaggaccggtgataatggccgacctgccttccactttcatattggcccccatccgtctcagctcatctatatgtttaaatcgggccgagtagatggtgtcggttacgacgctcgtgccgctggctctcgttaacagagatgtcatcggctgctgaagatcagtcgggaatcccgggtaaacaagcgttttcacgtcgaccggttttatctgcttctgcccgccgagcataagaagctgatcgtcactcgtctcaatgtaaaaacccatttccctgagcttcgccgttaaagactccaggtgagtcggtataacattatcaataatgacttctttccccatcgcggcgccggcaatcataaaggtgcccgcctcaattctgtccggaatgatcgtatgcctgcatccgtgcagctcttttacgccgtcgattctgattacattggtccccgcacctttgatttttgcgcccatgctggtgagcaatgtggcaacatcaataatctcaggttccttggcggcgttttctatcacggttttaccttcagccagtacagcggcaagcatgatattaatcgtcgctccgacgctgacgacatctaaataaatccgtgcgcctctcagcctttcggcgcgcagataaatcgcgccttgttcattggtgacttccgctccaagcgcctcaaaccctttgatatgctggtcaatcggccgcggaccgagatggcatccgcccggcagtccgatgaccgcctgtttgaagcggccgagcatcgcgcccattaagtaataggaagcgcggagttttttcactttgccgttgggaagcggcatgctgatcatcggggaagggtcaacgaccatttctcctttttcaaaatggacgtttccgccgatttctttcagcaggtcacgcagcgtttcaatatctgagatctccggaagcccttcgatcgttacttcggaatttgccagaatggttgcgggtatcaatgcgacggcgctgtttttcgcaccgctgatatgtacggttccgtttaacggatcgccgccggcaatattcaacttttccatgatagtctccttccataagaagatagctgcggagcgtaaataaaatggcattttattctgtctctgcaaataaagctcttgtccaaaatgtagccaattcgaagagaaagaatacaaggacattataaaataacaggaagaaaatagcgaagctttgcggggcatttttaacacaggatgcacagaggcccgccgggttcatattccggggaaacacactcttcactttgatactgaaggcccgctgccaaacaggaaaacataagggtgcggcaaacggatgcaaccggtttgccgcccttttcccccttatttattccagtcagccaagaattgctcgatgcctttatccgttaacggatgtttcgtcagctggtgaatgactttcagcggcatcgtaccgatatgcgcaccgcgtaaagcggcttcagtcacgtgctgcgcatgacggatggaagctgcgatgatttgagtatcaatgtcatgaatgtcaaaaatctgtcttatttctgaaatcagttcaagaccgttatggccgatgtcatccagacggcctaagaacggagatacataagtcgccccggctcttgccgccaaaagcgcctggttggcgctgaaaatgagcgttacgtttgttttaatgttcaggtcgctcagcgcttttacggcttttaacccttcagacgtcatcgggattttcaccgtaatattcggcgcgattttcgcaagttctttaccttcttcaatcatttcttcagcattcagggaaatgacttccgcgcttactgatccgctcacgacttccgtaatctcacgaagtctgtcatggaaagacacgtcagcttctttcgccactaaactagggtttgtcgtaactccggcaagaacgccaagttcataagcttctttaatctcgtcaatgtttgctgtatcaatgaaaaataacataaggaaagcctccccagtaataaattttcagaactgtaaaacatgattgcgctttctaaaggtaagacataaaaccgcctgtcaatgctgtcaggcggtttatggatgttacattggattaagcttggtttgaagaaccgaactcacgcattttgccgataaccgtttctttgatcgcttcacgagcaggtccaagatatttacgaggatcgtattcgttcggcttagctgccaatgtttcgcggacagcttttgcagaagaaatttggttttcagtgtttacgttgattttagccgtaccaagtgagattgattttttaatgtcggcagtcggaattcctgtaccgccgtgaagtactaacggaaggccggttgatttgccgatatcttccatttctttgaaaccgaggttcggttcgcctttgtaagggccgtgaacagaacccagtgcaggtgcaaggcagtcgatgccagtgcgctctacaagttcttgacactctttagggtcagcatagattacgccttcagcgatcacgtcatcttcctgtccgcctacagttccaagctcagcttcaactgaaacgccgtggaaatgagcaagctcaaccactttagctgtagttgctacgttttcctcaaacggatggtgagatgcgtcgatcattacagaagtgaaacctgcatgaatcgctttcgcacaagattcaaagcttgaaccgtggtctaagtgaatcgcgacaggaactgtcactttgtattcttccataagagctttaaccatggcaaccactgttttgaagccgcccatgtagcgtcccgcgccttctgaaacaccaagaataaccggggatttttcctcttctgctgcttgtaaaatagcttgagtgaactcaaggttatttaagttaaattgtccaacagcatatcctttttctttagctgtattcaacatttccgtcattgaaactaaaggcatgtcgaaagtcctccttatgtagcctgatttgcttcttctcgaaaaaagctttccacctatagcatgaccataaaaacctgtcatatgtaaaacaacagatcgctttttctccatctctaggataccaacttttcgacaaatcggcaacacaatgacataattgtttctaattttattaattcgattttagaggtaaatattttttcaccgcgtctctgatctcatcaatgtcaaaaggtttcgcaaaatgagtcagcgctccgagctcttttgattccttaatcatatcgagttctccgtaagcggtcatgataatgacgcggatggattcgtcgatcatcttcatgcgcttgagaatttcgattccgtccatgccggggattttcatatctaaaagcacgagatcgggccgttctttcgttacgatgtccagcgcctgtatgccgttggcggcctgaaacgtctggtacccttctttatggaacacttcattgagcaatatgcgtataccgtattggtcatctacgattaaaatcttttcattcatcattttacaccccaatattatcattttcgtcaaaaggaagcagttgtttatgtattctgtttgattttcacatttcctttaattataatagtctactttccgacattttctgagcattttctcttttgttgtatactgttcttgtatgtgtaaaggaggtttcactcatgttaaagatatttacgacgcagcttgcaggcattttttcccgcattcaggataaggagtccgatgcaatagaagacggcgcgcgcctgctggcgcaggcagccgtcagcggtcataccatttatttatacggcgcaaatgagatgcagggcattttgtgcgaggcggaactcggctcagaaccgatgccttctgtcaaagcgtttccggatacagctgattcgattacagaaagcgacagggtgctgatgttttgttcaggtccgggcacggctgaagaacaggcgctggctcaaaagctttatgaaaaaggggtcggcctcgtttgcgtatctcctgtcatcaaagatcaaaccgggattgaggaattttgtgatgttcatattgacagcaaattaaaaatgccgcttctgcccgatgaagacgggacaagatacggctttccttcattaatgacaggcctgtatgtctatcacgcgctgtcctttacgttaaaggaaatgatgcaggaatatgcctgatgcagaaaaaagacttgccgcttttaaaggaggcaagtctttttttattacttctgttctgcagcttgtacggaagcgccgataaagtctttgaataaaggctgaggtcttgtcggtcttgatttgaactcagggtggaactggcaagcgacataccaaggatggtctttcagctcgatgatttccacaagacggccgtcagggcttgttcctgagaacacaaaaccgttctcttccatttgctgtctgtattcgttgttgaattcataacggtggcggtggcgttcgtataccacttcatccgcatacgcttcgaaggctttcgtgtcttcctgaagcttacaagggtacagtccgagacgaagcgttcctccaagatcctcgacatctttttgttctggcagaaggtcgatgatcggataaggagtggacggatcgatctccgcagagtgagccccttccagacctaatacgtttcgcgcatattcaatggatgcaatctgcataccgaggcagatgccgaagaacggaattttattctcacgcgcatacttggcggcgatgattttcccttctacgccgcgatccccgaaaccgccgggcacgatgattccgtctgtgccgccagtcagctcttgaatattgctttctgtcacttcttcggcgttaatccatttgatcttcacatcagcgtcaaacgcatagcccgcgtggcgcagtgattcaacgactgaaatgtaagcgtcctgaagctcgacgtatttaccgacaaggctgattgtaatggttttagacaagtttttcactttcgtgacaaggtctttccattccgtcatatccgggtctttgcattctaatttcatatgatcgcagacaagcttatcgagtccctgctcctgaaggttaagcgggatggagtaaaggttgtccgcatcttcgcactcgatgaccgctttcgtgtcaatatcgcagaagagcgcgattttatctttcatatcttgagaaatcggcatttccgtgcgcacgacgatgatattaggctgaataccgaggcttctcagctcttttacgctgtgctgtgtcggttttgttttcagctcgcccgccgctttgatgtacggaacaagcgtacagtgaatgtacatcacgttttcatggccgatgtcgcttttcatttgacggatggcttcaaggaacggaagggattcgatgtctcccactgttccgccgatctcagtaatgactacatctgcgtttgtttctttgcctgcacggtacacacggtctttcagttcatttgtgatgtgcggaatgacctgaaccgttccgccgaggtagtccccgcggcgctcttttttcaatacggcagaatagattttacctgtcgtcacgttgctgaatctgttcagattaatgtcaatgaaccgctcataatgccctaagtcaaggtcagtctcagcgccgtcatcggtaacgaatacctcaccgtgctggtacgggctcatcgttcccgggtcaacgttgatataagggtcaaatttttggatggtgacgctcatgcctctgtttttcaaaaggcggccaagtgatgctgccacaattccttttccgagtgatgatacaactcccccggttacaaaaatatatttcgtcatttcgtttgctcctctcttcggtctgcgctacattccttaaaatgtgccgttttatagaaaatcatttcactaaaaacaaatgatgtgtaaaagaatttgggagatgaaaataagaaagctccctttcaatttcttgaaagggagcgtagcactcttatgaattctcttctttttgaagagcccaaaatacatactacatagttcgacaatgaaagtcaagatcgttttgctgatataaaatcagtctttgcgatcctcttcctcatcatcataatcttcctcatcttcttcaatcatctcatcttcaatctcaagctcgtcgtcatcttcttcatcgatatcttcgtcgtcaaagctgtctgcgtcaaggtcaatatcttcttccatttcatcgagatcgatgtcatcttcatcaacttcctcgaattcatcaaggtcgagatcttcctcaacggcttttttcgcttttttctttttcgcttttacagtcggctgtgtttcttcgtccagctgatcgtacggataccagctgcggagcccccatgtctgatctgacagagcaataaagcggccgtcaatgttgaggtctgtataaaattgggcgatacggtcgcccagttcctctttcgtaacaccgagcaaggagatcatttcattcagcagctcctggaacggaaccggttttttatgttctgagaaaatttcgtgagcgatttcaactaaagccatctgcttcagctgttcctgagaatattgtttgatactcaaggtcggacactccctttctattacttatatgtatctgtttctatcctataataagaacgaatttgtattgttttgttcataaaccatacctctcattataaacaaattaaaacagaatatgctaccctaaacagcgtaatttaagaaattttagagccttcccttcataaatcggctgatgtgcgaaaacaaagccgccggcatatgcgccggcggcccgcttctttctataaagactcttgtttttcggcgccgaatacagacatggtgagcaattcactgacatcataagtgccgatcgcgtcttcggcttctttcgctttcgtcccgtcaccgagcatggtcagacagtacggacatccggagctgatgaccgtcggactgacagaaagcgcctgctcagtccgggccgtgttgatcctcgctcccgtttcttcttccatccacatgagccctcccccggcgccgcagcacatcccgttttcgcggctgcgctccatttccttcaattgaacgcccggaatggcttttaagatcgctctcggcggctcatacacttcgttgtatcttcctaaatagcacgagtcatggaaggtaatcgtttcattgaccgggtgaagcggttttagtttcccctgtgacacaagctcggctaataattcagtatgatgatagacttcggcccggaatccgaaatcagggtattcatttttgaacatattataggcgtgcggatcaattgtgacgatttttttgattccgtatttttcaaattcgccgatgttgtgttccgccagctcttggaacagaaactcgttgcccaaacggcgcggcgtatcgcctgagtttttttccttattgccgagaatcgcaaaggatacgcccgcttcattgagcagctttgcaaatgagacggcaatcttttggctcctgttgtcgtaggaacccattgagccgacccaaaacaaatagtcgaactctttgtcttgttttttcatttctttcactgtcggaatctctgtatcagcctgctcccgccagttctcccgctctttccggtttaagccccacgggtttccctgtctttcaatgcttgtcatggcccgctgcgcgtcgctgtccatcttcccttccgtaagcacaagatagcggcgcagatcgataattttatcaacgtgttcattcatgaccggacattgatcttcacagttgcggcaagtggtgcacgcccaaatctcctcttccgtgatgacctcgccgattaagctcgggttgtaatcaatggctgccgccgcttcacgcgatcctccccctgaggaagccgcggcgagctgattcgccttcgtgtgctgaaaaacgggcgcgggcacccacggagattttgatgtcacggcagcgcctttttccgtcaaatggtctctgagctttaaaatgaggtccatcggcgagagcatcttgcccgtaccggaggccggacacatatttgtacagcggccgcattcgacgcaggcgtaaaggtcgacaagctgagagcggcggaagtcttcaatctttccgacgccgtagctttctttcgtctcatcggtaaaatcgattttttccagctttccttttgaatccagcctgctgaggaacacattcgccggacccgcaattaagtgcgcatgctttgattgcggcacgtacactaaaaagctgagcaaaaacaacagatgaagccaccatgaaacataaaatacggcggcggccgccggcgctgaaagactgccgagcacaaacgcaatggaggaagcgatcggttccgtccaagacagagaatgatcgtgccataaaaggttcatggcgttcccgagcagcaccgtcaccatcagtccgccgataaacagcaggacaagccccgctttaaacccgcgtttcaatctgacgagcttttcaatgtagcgccggtaaaacgcccagactacggcgattaaaatcagaaacgtgacgatttcctgaaaaaaggtaaatgccggataaagcgggccgaacggcagatgccggtcaggaagcagccctttcagaataaaatcaattgcgccgaactgaacgagtataaaaccgtaaaaaaacagaacgtggatgattccgctctttttatctttcagcaattttttctgtccgaacacattcacccatatcttctgaagacgttctttcaggcgtttatcaaattcttccctttggccgagcttaatataagcgatcctcgttctgatcaggtaaacgaataaataaacggcgtaagcggttacagctgaaaacagcagcgcgtttaccatgagaaatgcgttcatcttgtctccccctttgttctgattcccctcttcattgtcatatctttactttatcataaataatgaatgagtgttcagtcaataattaaattcacattctcagggcacactacggatacttcggaaaggagcgtcggtatgaaggtcatttttgttttgcttgtcatttttatcatattgatcgcacttatgctgcttgatatgctgcttggccgggcggcgtacaaaaaacaggcgtatgagcccgtttttgaccccaaaaaaagtgatatcacactcattcactgcggcagcgagcttgtgcagcagatgacggctgatatccgccaagccgtctcttctattcatatgatgttttttattatgaagaacgaccaagtcagccatgagatgtttgatttattgaaagaaaaggcccgggccggcgtctccgtatatctgctgctcgattgggcgggcagccgccaagtgaaaaagccttccattcaaacgatgaaaaaagccggcgttcacgttcattttctaaataaaccggcatttccctttctttttttcaggctgcaaaaacggaatcaccggaaagtgaccgtcattgacggcaaaatcggctatgtcggcggctttaatatcgctgaagagtacctcggaaaaaaagcgaagttcggaaactgggaggattatcacctgcggatgaccggcgaaggcacggcggatcttcagactctttttgtaagcgacctgaaacgaaacaccggaaaaacacccgaatcacccggggtttatccggcattatccgaagggaatatctctcataagacatatgcatctgacggtttttcgcttgaatcgcattatgaaaactgcatccgtaaggcggagaaaaaaatcatcatcggcacgccttattatgtaccgagcaaaaagcttcaggaagcgcttatttcagcctgccgaaaaggcgtcaaagtcatcttgatcgttccgatgaaatcagatcacccgctcgttcgggaaacagcttttacctattatcccgagctcctgaaggccggctgcctcatctatcggtattatcaaggcttttatcatgttaaagccttcattatagatgaccgcatcagcattatcggcacgccgaattttgataaacggagcctgttctggaatgaagaggtaaatgtcatcattcatgatgaggcctttacaaaggaagtgctttcaaccataaagcaggacatcgaaaaatccgagcttctcacattagaaaaagtgaaacagcgctccgtcagacagcttcctgcagaatggctgggaaaggccatatcttactttttataaaggagaaaccatatgctgttcagattcggattcgtcgcaaacgccatgtgcctttgggacgcgtcccccgccaaaaccttaacatatgcgcgctataccaagctttcccgcagtgagcggaaagacgctctgctttctgtgacgaaagcaaatcttaccaatactctgcgcaccctccactatgtggtcggccacggcatccctttgtacaggttctcaagctcaattgtgccgctcgccacgcacccggatgtactgtgggattttgtcacgccgtttcgccaggagtttcgtgagatcggcgggctggtcagaaaatatgacctcagaacgagctttcatccgaaccaattcacgctttttacaagcccgaaacgggagattaccgcaaatgcggtcaaggatatggcctatcattatgacatgctggacgcaatgggcatcgcggaccgttccgtcatcaacatccatgtcggaggcgcttacggtgacaaacaaagcgcgcttgcccgtttccgcgtgaatctgaaagaacttcccgaagtcatcaaacagcggatgactttagaaaacgatgataaaacatatacgtccgaggaaacactcagtgtatgtgagcaagaaggcattccgtttgtgtttgattatcaccatttttacgccaatccggccgatgacgctgatttagatgacattcttccgcggatgatcaaaacatggcagcggatcggcttaaagccgaaggtccatctctcctcgccaaaatcagaatcagccgtacgcagtcatgcggactatgtggacgcgaattttattctgccggtgctggagcggttcagacaatgggatgcggacatcgattttatgattgaggcgaaagagaaagaccgggcgctgctccggctcgtcgaagaattaagtgccatccgcggagttaaacgcctggcgggcggagtgctgaggtggaaggcataaccaggtttatcacacgttcatatggggaatttccgaaataacagaccatcagacggaggagaaaacacatgaaaaacattacatctttgaaaatagccgctaagaagttcactttaagaaacatgcttcagctttatcagctttgccacacgggaggccacgagctgtatatctactctaaaaaaacaatgtgcaaaatcaaagatatcattgagctggaaacgttcagaatggctcataaagaacaagaatatttaattgtagtggaaggaaagaaagcggtgcagcttgttgaccgtttcaaacatatcatcgaacctgcgcaaaaagaagcccattaaatacggactacataaaaaaaggatagacaggaggctgcccggcccccgctcgtctatcctttttccattattcatgtatcagctcgccgaattgggcctgatggagtctctggtatatgccgccggatgccagcagttccttatgatgaccttgttcagcgatgccttctttcgtgacgacgacgatcctgtccgcatccttaatcgtagccagccgatgggcgatcacaagcgtcgtgcgtccttcagacagctcttgcagcgatttttgaatggcggcttccgtttctgtatcgagggctgatgtagcctcgtctaaaattaggatcgacgggtttttcaaaaacattctggcgatggaaagccgctgcttctgcccgcctgacagcttcacgccgcgctcgccgatcaccgtgtttaaaccgtcgggatacccgtttaccagctcctctaaatgcgcctggcggacggcctgccggatttcttcctcagacgcatcgagccgcccgtacgcaatgttttcccgcaatgtgccggaaaacagaaagacatcctgctggacgacgccgatttgtccgcgcaatgatgacagcgtcatgtccttaatattaattccatcgatggaaatcacgccttcagacggctcataaaagcgcggcagcagacttgtcagcgttgatttccccgctcccgaaggcccgacgaatgcgactgtctcccctgcatgaatggacaaattgattcccgacagaaccgggctgttttcttcgtaaccgaatgacacaccatcataacggatattcccttttaaaccggacacatgtctcgcgttcggggcgtccttgatatcaggctccgtttccattatttctataaagcttttaaaaccggctatgcctctcggatacagctcaataatcgcgttgattttatcaatcggacggaacagaacgttcgtcagcagcacaaaagcgacgaattccccgtaagataacgatccgcggatcacgaaccatgtcccgcacaacaggacgaacagcgtgacgaatcttgtcagcatgtaactgatcgagccgtttttcgccatgattttatatgacttcagctttgttttgcggaaacgctgattgttcacgtcaaaccgctgcttttcaaacgcttcattgctgaaagcctgaacaagacggatgccgccgatattgttttcgaccctcgcgctgaagtctccgacgtctttgttcagttttgtaaacgcagaggtcatttttttattgaaatacaaagcaagccaaatgacgaccggcataatgataaaggtcaacagcgcgagctgccagttaatgaacagcatcacaccgaacgcgcccaaaatcgtcatgaccgcgataaacaggtcttcaggcccgtggtgggcggtttctccgatatacatcaaatcattggtgagcttggacattaaactgcccgttttgttgttatcataaaatttgaacgaaagcttttgcagatggtcaaaaagctttttacgcatatcggtttcaatgttaatgccgagcatatggccccaatacgtcacaacatactgaagcgccgagctgagggcgtagactccgaataaagcagcggaagtcaaaataatcagacgccaatcccgccccgggagcaatgtatcgataaagtaattaacaatcagaggaaaactcagctccatcaatccgccggcgatggcagaaaagaagtcgagaaaaaacagctttttgtacggtttataataagaaaaaaattgtcgcagcacgattccgtcctccttgtgcctcgttcctaatgataatatttctcaattatactatacacaaggagttttaaaagcgttttttataaaacgccggaaaataaccgcgcgaaggattccttcgttctttcccataatgtgcgcttatagaaacggacggggctgattttctcagactctctcatatcctcaagataatgcgcttcaagatctttgatcgccttttgatctgtaaaaaagacattgacctcaaagttcagctgaaagcttctcatgtccatgttcgccgtcccgacagaggcgaggtttccgtcagtgatgagcaccttttgatgcataaagcctttttgataggaatagacttcgattccttcgcgaagaagctcggggaaatacgatctcgtcgcgtactgggttaaaaatccgtcattggtttccggcaccatgactcgcacccggacgcctctggcagcagcctcctttagcgctgtgcggatcggctcattcggcacgaaataaggcgtcgcgatccatacagatgattcggccgccgctatcatggcataatacagatcgctcatccgctccttcatatcggggcccgtcggaacgacttgatagacgccgccgctttctgcagggaccgggcggctgtatgctttctgatcaatcagcacctcatccgaaacgtattcccaatcaagcataaaaatgctgtggagcgtctgaacgatttctccttcgactttcatatgggtgtcccgccaaaaaccgacactttggtctttgccgatatactccttgccgacattcagcccgccgacaaaaccggttttcccgtcaacgatgacgatcttgcggtgatttctgaaattgaatttttggttgaaaaaaccgtatttcagcggcagaaacgggacgatgttcacgcccgcgcgtttcagttttttaatgtcttttccggccagcttcaggctgccggccgcgtcgaacaaaaaccgcacttccacgccttgacgcgctttttccatcataatgtccatcatcttgtgcccaagcatgtctgatttgaacatgtaatactcaatatgtataaatgatgctgccgaccggagcgcttcaaacagctccggaaatgtttcatccccgtttttgagcaccttcagcctgctttttgtattgatattcatatgagacgccttgattgaatattgaaagaaacgcttctgatttcctttcagcccggacagatcgggcgtctgttccatatcaaatatcgttctcagcttttcccggttgtatgtccgtttcgacctgaacagcttgcctttttcataaagctggccggaaaaaaggtaaaataagtacccggcgatcggaaaaaacacaagaatatgaatccataacagcgtgtgctgagaggtgcggttttcaagaattaacgaatagatgctgaacaaaataatgcttgcatagcaaagcaaccctccgtaaaactcaagcctggaaaccggaaaaaaccatatgacatatgctccgataagcatcatatataaaaagcaaaattccagtctccttttcagcatcccgactctctcccatctgatccgatatctctgtataccctctgttttccggcctgtaaacatatgaaaaatcctctccgcacgagcggaaaggattatgatgacacttcctgtgactggccggttgtgatgttctgaagcaatgccggattgagcgagcagctgcctttgattttatttttgaagatgccgatgatcagaccggtgaccgctatcgacactaaggagaagagccctttcagcaatccgacggaaaaaatgccggccagcacgacgccaaaatcgaagaggaaattaacggcacccggattccatccgcagcgcttttgcagaaataaagcgaggatattggcgccgccgagcgatgcctgatgataaaacatgagcgacaggccgaacccgatcagcgccccgccgcaaatcgccccggcaagcggtgaaacagagaccggcggcatccagtgatccgcgccggtaaacagagtcagcacagtgactgcaaaaacggtggatagagtgaatttgattcccattctgatgagagaaaatataaaaaacgggatattgatcagaaagaagataatcgcaaacgaggaatgaaacaagtacgacaggcttagtgacagtcccgctgtgccgccggttaatacatgagaatgtctgagtgtcaggacgccggcgcttgtcatcagacaggcggctaaaatgaggaaaatccgcttcattcttcactctccttttgttgatattatttccacataaaacataacaggaatcaccgccgcccagccattaccttggcagaaaatatcttatgtttttattttttcaccataaaaaatccccctcttgcagggggatttttacgtgcgtttccgatagacgacatagctgcgggtcaaatacttgaggggcaggctgaacacgtgaaccaatcttgtaaacggccagaggataaaaacgacgtaccctatgatgatatgaaacttaaaccatagcgggacactctccatcaaagaagcgtcaggccggaacaaaacaatttccctgaaccacggcccgactgttgccctgtaatcaaatcctttcgagtcaatgttgagaaacgtggccgcaacgcccgacagcatcatgaacagcagcagaataagcgtcaggatatccgatggcgagctggttttgcggattcttttgtcaaacagccttctgtatgtcaggatcactagtccggcacaagccgcgatccccgccggcaggcctgcgccgatcgccattttgtgatacgtatgctctgaaatgccaagtgcagtatacacgccttccgggatcagaattcccatgacatgtccgccgacaacgaacagcagtccccagtgaaaaagtgtgctgcccgccgcaagttttttcttttctaacagctcgcttgatttcgccgtccagccaaactggtcatgctgatagcggtaaatatgcccgccgataaagatcgtcaataccatgtagggcataatcccccacaggatctgcccgctcatgcctgaacagccccttcttcagtgctttcacgtacaccgatgctttccagcgcggcctgcagcacgtgcagcagctcagcatagaggctgtcatttttttcgaggcgggaagccagctcccgcacattggacaggtatttctcaaacacgcttctcgccgcttcaatctccgcaaccgcggcgaattccagcatcagcggcaggtaatcaggcaattctttctctgtcggcaggaaaccggattgctggtaggtgtcttttaaatgcagcaattcgatgccgcgttccctttgctcgcctgagttaaagtaggtgacgtacatattcgtttttttcccgaagtcgaacgtatacacatagtgttcaatcagcgcttgcggagaaaagccggctgccgcctctaaaaagtgcagcagtttctcacggatttgctgattggtgacgtcatggataagagccttccaatcgggaagcccggctctccactcttcatccggataagagagaagaatggaaagagctgcgaacgtcatttgccggtctgtggtgttcatcttgtttcacctcatttatcaaaagttagaaacaagagccggggccgcctgaaaatgacaagccgcagcttccttgttcagcgtataaatcagacacttcttctcgatggctgctcgggatcacaaagcggtcatcatatttggcgatcgccagcagccgatacatgtcttcaatttgcttttctgttaaaccgacaccggagatcagtgccgggtcgatggatttattcgtctgaaccgccctcatatactggcgcatgacagacattttctttaacgttgaccgaatatgatccgtatcaccggccgttaatagctgggccaaatagtcaatcggaattctcatttggtcgatagccggaaaaatcgcttccgccgtttgccggctgccttttccttcaaagagattcataatcgggctgagcggcggaatgtaccaaaccatcggcagcgtacggtactcagggtgaagcggaagcgcaatcttccagtcaatgatcattttgtagatcggcgattgctgcgcggcctctatccattcagccgggatgccttgttcttttgccagtttggcaatctcagggtcattcggatcaagaaaaacgtccagttgagaatggtagagatccttttcattttcaacagatgccgcttcctccactttgtccgcgtcatacagcatgacgccgaggtagcggattctgcccacacacgtttcggagcagatggtcggcagccccgcctccaagcgcggaaagcagagtgtgcatttttccgctttgttcgtttgccagttaaaatagacttttttataaggacaggatgagacgcaatatctccatgaacggcatgcgttttgatcaacgagaacgatgccgtcttcctcgcgtttgtacatggcgccggacgggcaggaggacacgcacgccggattgatgcagtgctcacaaatacgcggcagatacatcataaagacttcatcgaattctgttttgatcgattcctccattttttgaacgtttggatcttcaagccctgtaatgtggccgccagcgagatcatcctcccagttcgggccccattcgatattcataaaatcgcccgtcaaggacgatttcggccgcgccaccggctggtgctttttctgcgggctgtttgttaatgtttcataatcatagttccaaggttcatagtaatcatcaatcgtcggctggttcgggttatagaaaaggcctgcaagccggtttgttttcgggcctgatttcagttcaagctttccttttttcaacgtccagccgcctttatatttgtcctggtcctcccattgcttcgggtagccgataccgggctttgtttcaacattattgaagtacatatattccgcaccggaacggtttgtccatgtgtttttgcaggtgacgctgcacgtgtggcagccgatgcatttatccaagttcatgaccattccgatctgcgctttaatcttcaagccaatcgacctccttcagcttgcggatgacgacattcaggtcgcgctggttccctgtcggaccgtaatagttaaagccgtagctgagctgtgcgtagcccccgatcatctgggtcggcttgacgtgaatccttgtcgggctgttatgggtgcctccgcggttattcgtcagttttgtgccgggcacattgatgtggcggtcctgggcatggtgcataaacgccattcctttaggaatccggtgagacaaaaccgctctcgccacgacaacgccgtttcggttgaagcattcaatccaatcgttgtctttgatatccgtgtcctttgcgtcatctttattcatccacacggtcggcccgccccggaacagcgtcagcatcggcagggaatcaaaatacatgctgtggacggaccatttattatgcggcgtcaaataattaagaacgatctctttgccctcttgatcaggccgcttgctcaggaacggacggtgctggaggatcggtttaaatgtcgccatcgtttcaccgaattccatcatcagttcatgatcgacataataggattgtctgccggtcagtgtccgccacgggattaatttttccacattcgtcgtaaacggcgagtacctgcgccctcctttttctgagccggtaaaggccggagacgtgatgaccgttttcggctgggctgtaatttgctcgaacgtaaagcattcttcctcgcgttcttccgccaggtctttcagcttcaggtttgtgatgttttcaagcgattcccatgcttttacggcgacctttccatttgaggtggacgacagggttaaaatcgcttctgccgcctgctttgcttcacttatattcgggcatcctttggcaacgccgtctgaatcggtttctcccagtctctttttgagtgattcatattcatccgcaatcgaccagctcatcccttttgttccgctcggttttaaagccgtctgagggccgagcgcggtcattttatgaaaaatgtgtttgtaatcccgttcagcgacatggatgttcggcatcgtttttcccggaatggcttcacattcgcccttgctccagtcattgatttttccgaacggctgggccaattcctgcatcgtgtcgtgaaggagcggcgtcgcgactacctctttcaccggctccatatcgacttcttccgccaggtcggaaacggcttttgacagtgctttgaaaatatcccagtctgacctcgattcccacggcgccgagatcgccggagcgaatggatgaatgaacgggtgcatatccgtgctgctgagatcgtgtttttcataccatgtcgccgccggcagcacgatatcggaatacagcgccgtaccggccattcgaaagtcgagattgattaacaagtcgagcttgccttccggcgcctgctcccgccatttgatttcttcagggcggatgctgtcgctgtcgtcattcatcaaaccgttcgtcgtccccagcagatgcttaagaaaatattcatgcccttttcctgagcttgagatcagatttgcccgccatacgaagagattccttgggaaattcacttcattgtccgggtcttcaatcgcgaatttcagttttttctcttgaagccgtgaggccacgtacgcacctacgtcttcagatgtcgccgcccccgccttctcagcttctttgtacagatcaatgccgttttgattgaatgtcgggtaggacggcagccaccctaatcgcgccgccaggacattgtaatcggcgtgatgcttgtagcgggatgaagaagcgatcggtgaagccaagtcactgatcggctggtcttcgtaacgccactggtctgtcgcaaagtagaaaaatgaggtgccgttttgcagtttaggcacgccttcccaatcctttgcatttgcgatcgtctgccacccttcagcaggacggagcttttcctgaccgacataatgagcccagcctccgccgtttacaccttgggcgcctaccaataaaacaagatttaacaccgcgcggtaaatcgtgtcggagttgaaccagtggttgattcccgcccctacgataatcatcgatctgccgtctgtatcaatcgcattttgggcaaactccctggcaatctgtataacggcttctcttttaattcccgtgatctgttcctgccaggcaggtgtgaacggacggggatcatcataagatgcggctgattgtccgccgatgccccggttcacgccgtagttggccaatatcaagtcaaatacagtcgtgacacacacctcttcgccgttcagttccagttttttaataggaagattccgctcaagcactttgtttccgtcatttgaaaaatacggaatgcgcaccgtactgatttcgtcctctattccgagcacggagagacggggctcgatctgttccccggtgtcttcgtcgatcatgtgcagattccatttctgctgcccgtcccagcgggagcccattgttccttgcggtatggcaaacgcacctgtctgttcattccagaccgccggcttccattgatcatgctttgtctgccgtccgatatccttcgcatgcagaaaccgtcccgctgtgtatacgccattttcttttgataaggtgacgaggaatggaaaatccgtgtattgcttcgcgtattccatgaaacgttccgtctcttgattcacgtaaaattcctgcagaatgacgtgacccatcgccatcgccagggctccgtcagtcccttggcggatactgagccagtcatccgcaaactttgaggactccgcaaaatcgggactgattgaaatcaccttggcgcctttatagcgggcctccgccaaaaaatgcgcatcaggcgttctcgttagcggaacgttggagccccatgtgatgatatagcctgaattgtaccaatcactgctttccggaacgtccgtctggtcgccccaaatttgcggggacgccggcgggagatccgcataccagtcataaaaactgagcattgggccgccgattaaagacatgaatcgcgaacctgacgcgtggctgatcatggacatagccgggatcggagaaaagccgacattccggtcaggcccgtatttcatgactgtatacagcagagaggctgaaatcagcttcagcacttccggccattccgcgcggacaaagccgcctttccctcttgcctgtttataggacttcgctttttcagggttttcaacgatcgatttccaggcatccagcggattttgatgcgtctgcaatgcttcccgccacaaattgatcagcacacctcgcacatatggatatttcacacggagcgggctgtagatgtaccatgaaaaactggccccccgcggacagcctctcggttcgaaatcaggcatatccggtcctgttgatggataattcaagttttgtccttcccacgtgacaattccgtttttcacataaatattccagctgcaagaacccgtgcagttgacgccgtgggtggagcgaacgactttgtcgtactgccatctgtttctgtatacattctcccaatcacgatcttcgcttgtcgtttggctatgtttatttgaatgatgttcgataggagaaaaatagtttaatctcctgagcaacggactcattttctttttcttcatgatcgttcactccttccgagtcaggtgatgctatgtacactataaacagagacggcgcatcaccttgtgaactatgtcacacactctgcttttttcacaaaacgttcacacagagcagcaggaaggattttcaaacgatatgaggacgcccgcgtcatcaaaaaaaccggttctgtttaagaaccgggttcggcgttttcatccagtgatgtatgcagataccgcaaaaacaactgataggaacagaagacattttgctgaagcatcgccaaaaagttcatttgcagccgcggatggtaagacatcatttgcttaaatacggaatatggaatatggagtaccagaatatccggtgaggcattgactgaaataaaaggcgataaagagagcccgcctttttcatcaatcggaaacacatcgcctttttcccacagcgcaacggtttgcgacccttcagggagcctgctgtccgtaaaacggatattgccttttaatacaatataaacggattgtgaatgaagaaaggatggagattggtcagatgagccgcggataaacgtcccgtttttcagcaaggtttcgacaatggacagaggcacttcattaaacataggaagttgtttcagaaataataaatagtcacactgattcataggaaagcctcctgtgctattgatagatttagtgtagcccgattgagcctgtacagcagtgatatatttcacagcttgtatgatgaatgtcacttatcggaaggatgactgcacttataatgaaataaaaaggagggtttcgatgaaagcgatgattccgaagcagcacggcgcatgggcgatgctgctgattccatttttactcggcatggtcaagggaggcccggttttctggcatattccgctctttctgggctggctgttcctttacttgacggtttatcccgtttcgctcgctttgaaaaagaaacagcttcagccttatcaaaagtggatatggtattacggttttccggcctgctgctttttgatcatttctgtctttcataagccgcagctcgtctggatcggcgtttttttattgccgctgtttctcatacatacgcattatgcccgccgaaaaaacgaacgggcgctcacgaatgatattgcgggagtcttgttcttttgttcaggcgggcttgcgagctgctggctgggaacgggaatccttgacggctgggcttggtttctattcttgcaatccgctttattttttgtcgggagttctttttatgtgaaatcggtcatacgggagagaaaaaacagaaggtttgcttactggtcgtggggatatcacctcttgctcccctttttatcggctcttctcggggcaggctgggcgtttctcgcttttatcccaagcagtctgcgggcctggttttttcacggaagagactggccggtgaaaacgatcggcattctggaaatcgtaaatgccggcttctttttcgccgtcatgtgtatatgtatcacaagctgaaaaacaaggacatcggctgcccttgtttttttcagtcaatattgcagatctcaagcggacaattttcacactcgatctcgcatcgtaaatagtcccgcttgtgcaaaataatttttccggtttcgtctatcgaaataaccccttgtttgcggaggtcgcccagcatgcggttgacgctctcccttgccgccgcgcaaaacttagccaaatcctgatttgtcagcacaatgttaatcagaatcccgtcgcttcgttccaccccgtagctgtttgataagcggataagggtggaatagagcgccccctttttgccgtgaagaagcagatccctgatcttagactggatttttcgcagatgggtgctcatccatttcataaattcaaacgtcaaaacaccgttttggatcaattccttttccagcctgtttttattaatgacgagcacctccccgtcctctaacactttcgcactgagcatatatctcggctcatctgtgaatagcgtcaattctccgacaatatcgtgtttttggcagattctaagtgtcaggtcttttccgtcagatgtcagcttgccgatttcaatgagtcctgattgaatcagataaagctcttctgcatccattccttcttgaaacaaatacgtgtgttttttcattttccttttcgtactgatcgattccagcaattcatgcagttcgcgggaaagaagttctttatcagattttcggacagagagaatattcatgagctcacctcgaagaaagtcacgttgcgtatgtatattgtaacgtgacttgatttgcactcacccagaaaaaactaacaatcttgtgaatggatcattatgaatcaaggctatgactgtttctctccgtatgtgttttcattctttcctgccaatacatccagatcacaaggacaaagctggctaacgcaacctctgaaagcgccataaacccgatcgcgtattgacccgttgcctgaaatacacttgccagaatcagcggagggaaaaaaccgcccagtccgcccatggcagacacaataccgttggcaatcccagcttgcttcgaaaaatagaaaggcaccagtttaaataccgtcccgtttccaatccctgagcagactgccaccgtcagcgatccgaacgcataaaggccgatcgccggggagaatgacagcatgacgcctgacagcgtaagccctgcgaaaacgaacatcagaatgcggagcgggctcagtttatctgcaagaaaccctcccacaggcctgagcagcgtagagaccgcaataaagccggccgtccgcagaccggcgtccgcagggctcagcccaaaatgctcaaccaaaaaattcggaagatagatggtaaaggcgacaaaggcgccgaacgtaataaaataaaacaggctcaacatccacagcacatgatttcggtaaacggctttcatttgtgtctttatggaaactttgactttcttctcatgccggtcgccgaacaaaacgtgcagtaatgcgaaaacagccagcaaaacaagatacatctgcacggttgctttccatcccgcggcttgagcgataaccggcgccgcaaaggtagtaacggcggtcccgatgtttccggcaccgtaaatcccattgacgacaccgtgcttttcttttggataatatttcgggagggacgtcactccgatggagaataccgctccgccgatccctaagaaaaagccgcccgtgattaaatcaaataaagaatccgcgatactgatccaaaatacgggaaacaaaagcaggatgaagctgatcataaacatcagccgcgcgccatacctgttcgttaaatatcctaaaggaatacggagaagcgatccgagaataacgggaatcgccgtcaccaatgaaatctcgcctttgcttaaatgaatatctgatgtcatttgagaaatgagcgatgaaatcagcacccacaccataaaccctgccactaagcttaaagactgcagcgataattgaatatgttgacgattgatcattcggcttgcccctttcactgattcaatatcagtcttatcatacaaaaactcagtgtgctggattgtgaattacatcacacgctttatatgcaaaaaaaagaacaaagcccgaagactttgtcctttgatcatcattacattttttccggagcggatacgccgatcagctgaagcgcattgttcagcgtaatttgcgtcgccttcattaaagcgagacgcgcgcggctcttctctttattttccggatcgatgactttctccgcattgtagaagctgtgcagagcggaagccagatcataaatatagtttgtgacacggtgaggaatgcgtttttccgccgcttctgccactgcttcagggaagccgccgattgttttcagcaggtcatattctttttctgattgaatatggctgaaatcaagatctgccgccggtttaagtccctgctcctccccttggcgaagcatgctgcaaatacgtgcatgtgcgtattgcgcataatacacagggttttcgttagatgtggatacggcaagatccaagtcaaaatccatatgcgtatcagcgctgcgcatcgcgaagaaataacgcacggcatccaagccgacttcttcaatcaggtcgcgcatcgttacggctttccccgtacgtttgctcatcttcattttttcgccgtttttgtataaatgaacgagctgaatgatctcaacttccaatgtgcctttcttgtaaccgagcgcttcaatcgccgctttcatacgcggaatatacccgtggtgatccgcgccccatacattgatgagcttgtcgaatccgcggtcaagtttgtctttatggtatgcgatatccggcagcagataagtgtatgagccgtcttttttgatcagcacacggtctttatcgtcgccgaacgttgtggagcggaaccatgtcgcgccgtcctcttcgtatacatggcccttttcgcgaagcgcctcgagcgcctgatcaatttttccgttttcgtacagtgacgtttcagaataccatacgtcaaacggcacgcggaagttttccaggtcggagcgaagtttatcaagctcgtactttaagccgtattcacggaaaaacgcctgacgttcgctctcctcttcatgtacgaaacggtcgccgaaatcttcggcaagctttttcccgatggcgataatatcctcgccgcggtaaccgtcttccggcatcggtttctcgaggccgagcgcttcaaaataacggacttcaacggaaagcgccaggttgttaatctggttgccagcatcattaatatagtattcacggctcacatcatagcccgctttagaaagcacgctgcacagcgcgtcacctaccgccgcgccgcgcgcatggcctaagtgaagatctcccgtcgggttggccgatacgaattcgacctgaatcttttcgccttgtccgatgtttgtctctccgtaatgttcacccgcttcaagcacggacggaatcagttttgttaagtagctgttgttcatgtaaaagttgataaagccgggccccgcaatatccatcttttcaatggaagctttgcctttatcaaatgacgccacgatctcctcagcgatttggcgcggcgctttttttgcgattctcgccagctgcatcgccatgtttgtggaataatcaccgtgtgttttgtctttcggcgtttctaacagtacgcttggaatctggctttcttccgccaggcccgctttcagaacggccgctttgatctcttccttcagcacgtccttcatttgttccgcaatattcatgcctttgtttcctccttatattggatcgtcatgttatgtacatgttcttggttttcgcctacagtcatgttatatgtcagtttgacggagccttccgaaccgccgacatcagattgaatgtttttcgtttccgtacggagctccatttgtccgaacggcagtttatattgagtgagtgtcgatgcccccggaatgaaccgctgtttcatttggatggcgcccgatctcattacgagaatctctttttctgtgatcttgacgaccgttttaatcttgcccaaatcatgctcttcgtgataggaaagatacgttttgccgtttctcacgtaatagaatccactcgatgtaaattcaaccgactcttcttcagagccgttatgaatgaatgattgcacatgaatggctactggtgtctcctgtctcatgctgacacttccttttcatcatcccgcttaacctgaatagtataagttttcaagggaaaaagttcaaccgcttcctcctatcttaccatctttgctgattggttttgaagataaacatgatttttaaggaaaatgaaaaaaccggaaatcctaggctgcgggataaatgcggttccttcggcggacggctttgtcaaaggggaaaagtttgcggtatttttgcgctatccttccgaatgaaaatgataaaatatgtcatatacataacgtggaagggagggattcggaatagtggcgagtgttttatcgtcttcagcggttggagaaaaaatcaacgaatggtatatgtacattcgaaggttcagcatcccggacgccgagtacttgcggagagaaatcaaagaagagcttgcaggcctggaagaagatcaggatcttcatctgtactattctctcatggaattccgccacaatctgatgctcgaatacctcgaaccgctggaatcgcagcggatagaagaacagccgagactatcggatctgctcgcggatattgataaaaagcaggcccggctgaccggacggcttgattattattttaattttttccgggggatgtatgagctggatcagcgggaatatttgtcggctataaaattttttaaaaaggctgagacgaaactctcatttattaaggatactattgataaagccgagtactttttcaagatgtctgaagtctactactatttgaaacaaacgtatgtatctaccgattacgcaaggcaggcatatgaaatatataaagctcagtcgtcatacgatatcaggctcatacaatgccaatccttattcggagcaaatttcctggatttaaaactatatgatcgggcaattactcactttcaaaaggctttttctttggcagaaacagaaaaacagcctcaattaatgggcaggacgctgtataacatcgcactttgcaaacaaagcctgaacgactatgaagcagctataacttatgttgaaaaagccattgatgtttttgaaagtgctaaaatgaccccttctttgccccaagcatattttttaatgacacagattcattataaattagaaagatacgacaaagcgctcgagtatcataaaaaaggagttatctattccgaagagtcagcagattcagtttatttacatgaattcgaatttttaaaatctttgtatgtgaacggacctgatgaggatgcaatgaaaaggagttttgactttttggaaagtaagatgatgtatgcagatatagaagattttgctcttgatgcagctaaatattatcacaaacttgaagattataaaaaagcttcaacatactttttaaaagttgaagaagcaagacagcatattcaagggggggtaactttttatgaagctgaagtataaggtcttactcacttgcttagctgtaacctcagtttttataacagcagatatgacgaatacaccttcacaccaattcgaagtagcacaaagagctatgatttaaatgataattacttttaggcttgcaggttaaactgcaagccgttttttatataaacaactaatttataaaaacaaaaaacataccttagaactcaaatgtgtaaaaagtatttgacacttatacatatattatttaaaataaatatatataaatttgaaaatttaaaataaaaaacaaaataagttaaggagggttttagtggataacaatataaaaaaacttagaacagcagctgatatttcacaaaatgatctggctaagctctgcaatgtgaccaggcaaaccatcaatgcaattgaaaataataaatatgacccgactttaagtctggctttttcgatagctcacgctttaaatacgggaatagataaagtattcaactataacgccaaaaaaaattaagggagcggttcttatgaagaaaatggatgagatgcaaaaacaccaatcgggtacagccgccagaatagcatttagtttttatactgtcgttttactgatatggtcattaatagattattttaaaaacggaaatacaggatggcaatttccgattcttttaataggctgcgcgctctatttatggattcaagtttatcaaaatcgaaaaacaaggtaacgattccaatacacttccggaggattatacagcaatgtacgaatacaagttcataaaagcagaagtaaaccgatggaaaggaaagcctaaagaagactataaataaattattgaaaagtattcgcagcaagggtgaaagctggttcaaatatttgctcctgctatttcaggctatggggcagctgattattttgatattatttttgaaaaaaaagtataatgtttcagtaccaaagaaagccggatcatacatagggtccggctttctttgtacgaaataagccagcagatacttttacggatttcacctcttaactattattttttcggaaatccgcaattcaaatagattccaatatattttattatttaacttgctggggatattgaaaaaattggaggaaaaaatgaatctacttttaaaaacacaaaatagtaaagcgatttttacattagtagcatcaggaatcattgttctcgctcttttcagtatgaaacataatcatttaagcatggatgttatcgatattttaaacagagctggaattatcgctcctagttggattgtcagtgctatcaccgcaacgggatcagttctggctatcattactgttttaggatctcttggtgcaggcttgccattggccgttttagaacaattggctgcagcaagtacagcagcagcataatataaaacattaaattcaatatccctggcagtccctttaacgaatggatgaaaatacattgtttaaaaagaatgttttagtcaaattgtacatactctgtctgatcttatttttaattgctttatttacagcatatttttatacagattccgcttcaaatgtaaataatctaaatcgaaatatccgtccggatttttttcagattttctttaataatattaaagtagcgagtctgcttgtttttttaggcccgttaacgctgtcgcttggcacggttgctgttttaattattaatggattaattttaggaaatgcgataggaaacattaaagacaatttaaaccttttactgcttgttataccccatggaataattgaagtgccggtattgcttcttgcagcctctgtaggaatgaaattaactttagatttattactcctcaaaataaatttgaaattcacttttaaatatattggtattatatttctcggtttaatgatagcagctatgttagaaacatttattacacctatctttataaaaggagccttttaggattatgcaaattgaattatcttcatttaaggaacgaaacattaattttttgtcctcgtttttgttttatattatcgggttagctttttatttaagttcccttttaccttttatgaaaagtttaattcccaaaaacatccctatacaagttgttgagcaagtaaaacatttagattacatcattgcaatagccgcactgtttcttttaatgttcggggtcatttttgaaggattcgtattatttctcattataaattttcttggcgctcagattaagatcaaaactttttattccctatttatgttttctaacatcccggtcgcgattaagttttttcttatatcattcaaaaatattttcgcacaacatccaaacactagtttatttttcacaagtaatcatttgattttttctatctttgatttgttcaatattgcatacttatttcttttgtttattcttctgaaatggagaacaaatttgaactacctgacaatctcagtttttatttttacggcattcctgtatagaatgtttttttagcatatataaataaaccccctcaataggggtttttctttcatttcgttcactgtatacaattccttttatatgcttccgaaacaataccgactctagtacttacattccactttttacaaagaccggctatgatatattcgacattacgctgcgagtagtttaatgacttagcgatctctttattaggcttttcagcaattatcagtttaattactgaaatttcaatcttttttaattccaattcattttctactgctgttttcattctaacttcctttctaaagatgtatttactaaataataccctattatatattttttatcaataacatcaattattaatagtaaaataatatatttcttttactaacttctaagtagtttatatacaatataaaaatcccccgccatgtttcaagcgggggaaattctttctatttcacaaacccaagcagcatttcacggatcatcttgcttgccgtgtttgcggtttgttctgagtggtcatagaccggtgccacttctacgaggtcggcgccttttacgctgacctctgagcgcgcgatttcatggatggacgcgagcaattctttagacgtgatgcctcccgcgtcaaccgtgcccgttcccggcgcatgagcggggtcgagaacgtcgatatcgatcgtgacataaacagggcgtcccgcaagctgcggcagcacttttttcagcggctcaagcacttcaaacttagaaatgtgcatgccgttttctttcgcccattcaaattcttccttcattccggagcggatgccgaatgaaaatacgttttgcggcccgatgagctcggccgctttgcggatcggagtagagtgggaaagcggttcgccttcataatccgtgcgcaggtcggtgtgcgcgtcaaaatgaatgatggcaagatccggaaacttcttatacatggcttttatgacaggccatgatacaaggtgctcccctcccatgccgagcgggaacttgcctttttctaggatgccgtccacgtattcttcaatcatatcaaggcttctttgcggattgccgaacggaagcggaatgtctccggcgtcaaagaaattcaaatcagccaagtcacggtcgaggtacgggctgtattcttcaagaccgatagacacctcgcggattctccccgggccgaaccgtgaacccggacggtagctgaccgtccaatccatcggcatgccgtaaaggatggcgtccgcctctttccagtcggggcggcttgcgataaatacttttcctgaataagcttcatcaaatctcatcaataataccctcgctttcctgtaaaaaagcgcaagattcgctcctgcgccgtacgtttttatttgattaagtcgctcacaaatttcggaagaacaaatgccgctttgtgaagctctttcgtgtaatacttcgtgtcgatgtcgaagaaacggctgtcctccacttcaagcggatcgtactttttagaaccgatcgtaaatgtccacaggccgctcgggtacgtcgggatattagccgtatacagacgggtgatcgggaagatttctttcacgtcacgctgtacgtttgtaatcagctccggtgtaaaccacgggttgtccgtctgcgcgacgaagatgccgtcttcttttaacgccttggaaattccggcatagaagccttttgagaacagattgacggccggtccgaccggttctgttgaatcaaccatgataacgtcatactcattttctgatttcgcgatgtgcatgaaaccgtcatcgactctcacatcgacgcgcggatcatcaagcttgcccgcaatggacggaaggaattttttagagtattcaataaccttgccgtcaatgtcgacaagcgtcgctttttttacgcttgggtgcttcagaatctctctgatgacaccgccgtctccgccgccgacaacgagaacgttttccggattcggatgcgtaaataacgggacgtgcgcaaccatttcatgatagacgaattcgtctttttcagaagtcatgaccattccgtctaagaacagcatgttgccgaattcttctgtctccaccatttccagatgctgaaattccgtctgttccgtatgtaatgtttgtttcacctttaatgtaatgccgaaattcttcgtctgcttctccgtataccaaagctcgctcaattgtcatctccctttcaaggcttatttcatttattgtaagcgtctgtatcgcttttattccggttaaaatctcattttcacctaaggaaaaagtatagaggatggaggggaaaaagtaaagaagtgtccggtctgatatgtttaaaaaacccccttttttcacataataatagaatcatgaaaaagggggttcccaaaagtggataaagtatctggaaatcagctcagaatcacattcaaaatcatccgcgcctgcatctttctgacactgatcggcggaatgctggccggcgtctgcttcacatccgttcttcttgcagcgaaatggcagggcgccccctccgtccgggttcctcagtctacgattctttatgcaaatgacggctcaaagctaggtgagaccgatttcggggaaaagcgctactgggtccggttaaaagatatcaatccgacagcggtgcaggccgcgattgcggtggaggatcaaaacttttacaatcaccacggttttgattaccggcggatggccgccgccgcgctggctgacataaaggcaatggccaaggttcagggcgccagcaccatcacccagcaatacgcgagaaatctctaccttgagcatgataaaacatggaaacgaaaatggaacgaagcattttacacgatccgccttgaacagaactattctaaaaacgagattttagaaggttatgtaaatacgatatattacggccacggcgcatacggaattgaagccgcctcccgcctgtatttcggcaaacacgccaaagatctgaacgatgcggaagccgtgcttctggcgggcataccgaaaggcccgtccggctattcgccatatgtcagtgaaaagaaggccaaacagcgccaggaaaccattctccgtctgatggccggacaaaaaatgatctcaaaagaaaaggcggaaaggattaagaaaacgccgcttgcctatcagccgctgaaaagcagaaccgcggcgaaaacggcgccttatttttacgatgatgcgatgaaagaactcgagaaaaagctcggcatgacgcgcgaacagctcgcaacgagcggattgcgtgtttatacaacacttgataagcgcatgcagcggattgcggaaaacactgtggcacatacgatccgtaccggctctgacattcaggtcggcttttccgcgattgatccggcaacagggcgcgtgcttgcgcttctcggcggacgtgactacgaaaaaagcccgtttgaccgggcgacacaggcgaaacggcagccggcttccacgatcaagccgcttttgtattacaaagcgattcaaagcggctttacaccggtcacgctgatgaaaagcgaagccacagagttccagattgacgacaacggagatacctattctccaagcaattacaacggctactacgccaataaaccgattacgctgcttcaggcgcttgcgttatcagacaacatttatgccgtgaagacccatctctttctcggcatgaataagctcgtgtcggcggcaaaggaattcggcatcagcgaacatttaaagccccttccgtctctggcgctcggaactgaacccgtgcgccagattgagatggttaatgcctatgcgatgctcgcaaacgggggaaaacaaatcaccccttcctttatcacaaaagtgacggataccgccggcaacatcttgtatgaacagccgcgcggacatcagcagacgcttgataaaaaagccgcttttgtgacggcgagcatgatgacgggcatgtttgatgaggatttaaacggctatacttccgtcacgggacgcaccatttcagaccggctgacccggacgtacggcgggaaatcaggcacgaccagcgcagacagctggatgatcggctttaatccggctcttgccgccggtgtgtggacaggctatgacaaaagcagcacgattgattcagtagaagaaaaaagctatgcgaagacgatttgggcggactttatggagaaggcgctcgaaggagaaccggaaatagcgcttaaaccgccgaagggcgtcacgggcgtctatattgaccccgcttccggctacacttcgggacccggatgcgccgcaaagcattacacgtatttcatcgcaggcactgagcccgcggatgtgtgctacggaccggaaccgtctaaaaaagaaaaggaacacgtccccgcccgtaaagaagctccgcgcaaaaagtggtgggataagtggctcggcaaaaaagactgagcccggtgcattgcgcgccgggcttaatccgcgtcttcctcaagcacccatgggagcaagagtgaaaagtcgagatggataatagggtcaggaaaacccttcggtataaaaaatgttgtactaggcaaagaaaacgaaaagcggatatctcccgctctctcaatgtgaaacttcggccagccttccctaagcatgccgacaatcggatagctgcccgcataatgatgcaggccgttttcctttccatgctcccccaaatcgtgacagacagccggacgaatcccaaactgcgtaaacaatcttgttttctcggcgggaaggagattcaccgcctcggaaaagttccggcagctcccgcaatcgcagggatcagcccatgatttttcatattgctttctcgtttccgctgtatctgcttcaatgacccaaggcccgatgtcaaagacggtgaacatgatgaaacctccgcgtaaacatgaaaaaccccgagtcttggttcggctcgggactttccatgtcctgattctgtatcaacagtttactcagtacaattgcaaattagtgcaaatatttataaagttcacaaaaagttcacaaattatttttcgtccggaagcagacccgttttcaattcatcggatgaacgttcccagagcccttggtcatgcttctgcagaaattcagcaagcacctgctttgagctggcgtccattttgtccacgataatgcggcgcttcattgatttatccattaaattcacatgctccggcaatgacttatagcctctgcggatacttctgtccacggtcatttcacaagccgtcacacccgcgtaataagggccttcttcttttctgtcgatggtgacccacacgagccagtacggttttccgttcggcacttcatctttgttcggcaggaatttgatgcctttttcaacgacactgcgggcatgcattgcgccgatgtctacgaaagcttccttctcttccacatcgacaaataccggagaaatattgtcaaggctcagcgacccggcgccaaaaccgccatgtccgtcggtcggatcacttttaataatattaaatccgattgttttcttctttttttcttccatgaaaataccctcctacaaaagcggttgaaatataatggcaaataccttgagaatccagtctctcccctcgcttaacagcggccacacgacataggagccgaccggtgtcacaaacagcacgagaaacacgataatcccgtagctctcaaactgagtcattttggcgcgcacccgcggcggcacgagatcctcaataatccggtagccgtcaagcggaggaagcggcagcaggttgaataaacacagcgcgagattcagctgaatccaaatagagaaaaagcggtcaagccccatgctgaatgcagaaagcagctccattccgtaagcatgcatcaacactagcaaaaagaaaccgataaaggcaagaagcaggttgcttacgggcccggcgacggaaaccagcactcccgccagccgcggtcttttaaaggcgcggcggttcaccggcaccggacgggcccagccgaaacccgcgaccaaaattagaatcgttccgaaaacatcaagatgtttaatcggattgagcgttaatctgccctgtctcgccgcggtatcgtctccgaaccgatacgcgacatacgcgtgcgccagttcatgcatcgtaaatgccacgatcagcgtaatcacgacatagggcataagctccagcggataatataaaaatctgtccaaatgtcaaaatccccttttttaaaaaatgcaagattgtccttcattcagtatactataagtgatctctcttccaaagagaggaaacgataaaggaggatcagcaccatgccgctcgtaaccgttaaaatgcttgaaggccgcacagatgaacaaaaacggaatctggttgaaaaagtgaccgaagccgtaaaagaaacgacaggcgcagccgaagaaaagatcattgtcatgattgaagaaatgagaaaggatcattacgccgtcgccggcaaacggatcagcgatacggagtaatccttgataatggccggcgctgctatgtcaggccggcttatttcacaaccttttcaaccaggctgaaaaagattttcttttcttcctctgtcaatgcttcgaacagttcatcaatgagcagctgccggttttcaatcatttgcatggccgccatttttcccgattcggaaagcgtcatccataccgtgcggcggtcttcattgtttctcgacctttccacgaatccttctttttctaaatgattgagagcggttgtcgtggcggaaggcgataatgtgacctcctgcaatatatctttaatcgtgcacgtgccgtgccggtaaataatcctcagaataaatcctctgatattgtttatactcttcggaattgtcgcctcatcaagctttttcgtgctctttaaatatttcgtgagcgcgtaatccagtacatttgcttgcaagttatcgtgcttcatgcagaaactccccatttcaagatgcatccatcatcatttgtttgttttttattacattttactgataccttacggagaaagtcaaaattccggccggaatgcccgcaacttttatcctgccctgcacagacttttgtctccctcttttttaccatatccttttatgcaatgctggttttatagacacgattcaggtaaaatcattaagggtgactgcgtttgacggaaaggataatctgatcggatgcggcagacaatatgattggaaaagaaaagaaacggaacagacggggaaacagaacacaggattgtcgattacacagaagatgtgacacgggtaaaagccaaagagtccctcttggcttttgcttttggatggagggatgcgtgttgcggaatatcctacaaaaaaaagacatcacccagctgcttgaacaaagcagaaaaaggcagactgccaaaacgatgggtggatttgatttaacattactgggcatcggcgccgtcatcgggacgggcgtcatggttcttacaggcattacagccgcgaaaaacgctgggccttccgtaatcttttcttttatcattgcagccgttgtctgcagccttgcagcattatgttacgccgaaatcgcttctgttctcccggtttacggaagcgcctatatttactcttataccaccatgggagaaattgtcggccatttaatgggctggacgctcttatccgtttatatggtgacggcgtcggcggtggcaagcggctggtcaagttattttaataatctgttagccgaaatcggcatgcctttgccggacagtctgctgcacgtgccgagccaggggggcatcgtcaaccttcctgccatcatcattactctattaattgccgtcgttctgtcacgaggctctaaagagagcaaaacctttaataatataatggttctcgtaaaaatcggaattgttttgctgtttatcatcacaggaagcttttttgtaaagccgggcaattggcatccttttatgccttttggaatcaaaggcgtcattacgggggcttctgccgtcttttttgcgtttctcgggtttgacgcgatttcggcttcggctgaagaagtcaaaaaaccgcagcgcaacctgccgatcggtattatcggttccctggtgatctgtacattggtatacgtcatcgtctgtctcgtcatgacgggtatggttccgtattcacagcttaatgtgccggaagccatgtcttatgtgttacagactgtcggacaaaacgcggtggcgggcgttatcgctgccggtgcggtgatcggactgatggccgtcgttctcgcccatacatatgcggcgacccgtatatcttttgcgatggcaagagacggaatgctgccgaaagtctttaccattgtcggaaagaaatcgggagcgccgatctttaatacatggctgatcggactgatcagcgcctgcatcgcgggttttgttgatctgaaagagctgtcggatctctcaaacatcggcgcgctattgacatttgccatggtcagtctgtccgtgctgattctgcgccgcacccataaagatctgccacggggatttaaagtgccttttgtacccgtactgccgattttggccattatctgctgtttgtttttaatggtcaatctgccgctgaaaacgtggctttattttgccgtctggctgatcatcggcgtcatcgtttactttttatattcgtacaagcacagcaaattgagacaataaacaaaaccaggcccgcttcatcgcggcctggttttttcataaaaaaagacgaaagccatcgcctttaacaaatgtgtttcagctcttctatgtagtgaagcgcctcatcatattcttcatccgtatatttctgtttgctttttatcgtaaacactttctctttcttttcctcagcttcaaggccgtcaaaatacaaaatcgtagacaccagctccagaaaccgggatgagcggctgttgacgctgtcgatgtacttcttcatatccggcatcttaagctccgcatgatgtaaaaactcggctcccgtctccgtcagcgagtaccggtattgaaagtagccgccctttttttccttcacctcatccagaaacccaagattgcacagctcttcaattcgaagcgtcagttcttcggaatacgggccgtaaaaatgaaaatcatatttttcgtagaaaggatactgcattttcttcgcgatataaatgattttctgcagctttttccgcccgatgatttctccagaatccgagaacaccttcatcagttttgcatgttctttcaacaaattcccgacatctccttttccttctttaccaaaatccttctatgtcagtcccagcagctgccggatttttaattttgcttcagggttttctgaatcgtcgcaaatgaggtccatcggatagtagagcttatggtccgtccggcgtttgcccgaaatggattcgacaatggcggactgcctggacagctctttgatctggccgttctgcgttaacagatgaatcggcagacgctcctcctcttcacccggccggtaaaaatcatacggcagatccgatgaagaatcgaccactaaatagtaattgggatcaattcccgcctctttaaagagagcggtcagttcaaaataagccgacatttcctcattcggattaaattcggcatattgaaacagctggcggttaatgaagcggcggcacaagtcggacagaatcgggtcctcttcttcctcccaagcctggaaataatataaaatgatggcttcatcaagcttcagataatccgcaagcgtcagcttcccttcaaaaatggaataaaaatgaacgggagcatgagtgaatatatacccttcttcatggagctgcttcgcacggtggagaattttcgtcaaaatgacttcagcgcttctcgtcacgggatgaaaatacacctgccagtacatttgatagcggctcataatatagtcttcgacggcgtgcatgccgctttgcttaatgacgatctggtcctctcgcggacgcatgacccttaaaatccgttccatatcaaaatgtccgtagctgacgcccgtatagtatgcgtcccgctgaaggtaatccatcctgtcggcgtcaatctggctcgaaatcaggctgaccacctgtttgtttttgtatgttttggcaatgacttcggcaacatcctgcggaaatcccggtcccgcctttctgagaacctgattcacctcggtgtcgccgagaatgatttccctcgtatagtcttcatgatccagatgaaaaaccttttcaaaggaatgcgaaaacggcccatgtcccaaatcgtgcaaaagcgcggcgctgagacagagttcgcgttcattgtcatcccattcaggacgccctttaaaaacatcatcaaccattcgtctgacaatctcatagacgccgagagaatggttaaaacggctgtgttccgcgccgtgaaacgtcaaatacgtcgtaccgagctgtttgatccggcgcagccgctgaaattcacgggtgccgatcaaatcccagatcagcttgtcccgcacatgaacatagcggtgaacgggatctttaaacactttttcttctgataattttccgtttggatacgccatcgtcattccctcttttttttagccgtgattctattatatcggctctgtaatttgaaaacatccttgaatttgtccggcgttttgttccagttttcaatcattgattttttgaagcaaaaaagcctgacccatcgggcgaggctgtcgtaaaaatgcacatttactttttgatcttctttttcactttctcaatcagctcgtcctcagtcggcgccgacagcgggcggttgtttacgaaagcaaacgattttttgcgtccgggcccgcaatatgactgacatccgacctccacttttgcatccgggtcagcttctttcaaacgcggcagcaatgtcttaatattggtggcctggcaatcatcacacactcggaattcattagccatgatgtacgcttcccttcattcaatgttcctctatgttaaatcttaaattttaaaaacgaaaaaaatcacatcacgttttattgtacaaggattcatcttatcctgcaaggctctgcgtatctctcattctttcagccaatttgtataaatattttccaatctggacattctaataccatcaagattattgggggttgagaacattgacaaagcaaagacaggacgcctggtcggaggaaaatgacctgctgcttgcggaaaccgtgctccggcacgtccgggaaggaagcacgcagctgaacgcctttgaagaggtaggcgataaattaaacagaacgtcggcagcgtgcggattcagatggaatgccgtcgtgcgccatcaatatgaaaaagcgctacagcttgcaaaaaaacagcggaaacagcggatgcgcgcgctcggaaacggccagccggccaagaagaaactattataccagccgcctgcaccggatgcggacatcattcaagaaaccgcagccgaagagacggttcaaacggaagcgccaaaagaggatcggcaagccgtcatgtccggcgaacatatgccttatgtcgatgaaagcttcaaggaagagttagctagtttatcacatttgctggcgcctcagcagccgagccaaaaggcggagctcacaatggcagacgtcattcaatttctgcagagctatgaaggcagcggaaagcaaacttccgccctgcagatggaaaatgaccgtttaaaacgggaaaaccaagaacttcagtctaaaaccgagcagctggaagcggccgtcgaaaaacttgaaaaagatcaaaaaaccattcaggaagactacgaaaccttggtgaaaattatgaacagagccagaaaactagttttatttgaagacgacgagcatgcgtctccgtcctttaaaatggaccggaacggcaatttagaaaaaatggccgaataacgcaaaaaaccccttttcttgtcatggaaaaaggggtttttgccatttgtcaatgacgcgcatcctgatctatattaatgtaaacattgttcaggaggccttcttcccgcaagggctgcgcatctcggtccccgcccgcacataagcataaagattcaattcctcatcccaaatggttcttgggaattattgatcgattagctactgtgcaatacactgtatagagaatacaattattagatatgatgggaatgatagtaaatgagtagccaattacgaaaaggagcattggaactttgtgtgttgtccctgcttctttatgaagatttatatggttatgaattaatcaaggtcataagtgaaacgttccctgtatcggagggcaccatctaccccatattacgaagacttacgaaaaataactatttaaaaacgtatacagcagcttcagatcaaggcccgtcacgcaaatattacaaagtaacagaagaaggcgccttttatcatcacacattaaaatcggaatggcttgacctgtccgaaaaagtgaacagcatcattaaggagggaaaatgaatgtgtaaagaccaatatttaaaacatctccggcgggaaataaaagatctgccggaacttgaacaaaaagagatactcgccgatatcggcgaaatattccaaatgggcggcgctgaaggaaaaagcgatgaacaaatcgccggcaatttaggaaaccccaaaacacttgcgcgcgccttaaaagcggatattttcatcagtgatgccgaggagcagaaaacatggcgctcctttttcaaagcatttggcctgatgctgggtatgggcatgttcaacttcatgtttatgctgacaccgtttctttttgcctctgttgcggtgttaagtttgatggcaatcggcctgatgctgatgaccggatcattctttctcctcgtaaaagtgccgattgtaacagccatttttaacggatgtatggtcctcggagcgggtatggcggtgtttatggccggatttgatctttcgaaactgatattccgcatctttttgcgctatttcaaatggaatgtcagcattgtaaggagggaaaccattgaatcgaaaaatgtggtatagcattgctctcattttaatcgctgccggcctgatcggaagcatgttcttcggttttgacggcttttaccctaaatcataaggaaggtgtgcaagtagcatgagtgaaccagccctgatattaaaagatgtctctaaaaccatcaatcatacccctattgtacagtcaatttctttcgatgtgagaaaaggtgagattttcggccttttagggccgaacggctcaggtaaaaccactattttcagaatgatcgtacagcttattaaaaaaacagaaggagccatttcattcagaggcagaccggacagcgactttgaatattttatgagacatatcggggttatcattgaaacaaaaaagcccggactcagtccaagctttcctgcgtgccgaacaccttctcattccgttccagcattcggatcagatttttttcaaataccatttcctcttccggcgataatccggctgcatacaggcgtccgctgagttccttcagttcagtcaaaagcgccagcattaagtcctgcacggtaatgtccgtttgcagcaattcgcttaatgaagccatcgtttcgggccggatatcgggatatacgccttttgtatcgttgcttttgtcttttaaagcggcttgatagaaacgtctgatcagatcggcgcgttcgcttccgcttttatcggcacagaggtaaatctgaaccgcggttccgccccgcaggcgtctttgtgagattcccgcgaattttcggccgccgatgctgagatcatagctgcccggacagtacgatcctttaatttcatatgcttcaatttcggcattgtacggacgcagcatccgccgcaccagctctgtcatcgcctcgtagcctctgtcaatgtcgatgccttttttctcatcttcaaaaataagagaaatattcaatacgccttcatcgagaacgaccgcgaggcccccagagttgcggacaatgacacggtagccttcgccctccagcaatttcacgccgtcctctaaaaacggcaggcgtgtgtcctgaatgccgagcacgatcgtccggtggtgcacccaagtgcgtgccgtcgcaggcgattcccctttgcctacggaggcgcacagcgtatcatccattgcgaatgactgcttcgcatcaaaataagggccgaggctggattggtcaatgattctccagctcggctgcatcagtaaatcaatcggttgctttcccatctatattaaatccctttcgtcataagctttccatgcgtttattatatcactccgcttgagatgattgaaattggcttttcaaaagagcgatgaagatttctttgttttttgtgttctccataatggaagattggatgatagacagtttccgttttaaggagaatccttttatctcaagcacggaaatgctgccgtgaagcagatccttttgcagcacgctttttgacagaacggaaagacccattccgctgatcacggcttccttgacgccctggttgctgctgatcgtcatcatggatttcggccgcagtccgtttgattgaaggacgtggtctaaatattccctcgttcccgaacccttctcccttgtcacccacgcttgattttgcaattcggcagccgggatgttttttctgccggcgagcgggtgtccgttcggtgcggcaatgcacaattcatcctccataaacggctgaatgtcgagctcatttttccccgtatgcccttcaattaatccgatatcggcttgaagcatccgaaccgcttcgctgacctcctccgtgtttccgatcatgacgtccaggttcagctcgggatactcgttatgaagctttgcgagaagcggcggcagaatatattcgccgatggtaaagctcgcggcgattttgagcttccctttgacataatgatgatgggcgtaaatttcggatttcgcctgttcgtacaaaaagaccatctgcttggcgcgctgatagagaatgtcccccgtcggcgtagtcgtaaagtgcttcggagagcggttcagcaaagcggtttgaaattctttctccaggtttttaatgtgaaggctgacgcttggctgagaaatcatcagcttctgcgccgcctttgtaaagtttttttcttccacgacggcaatgaatgttttcagttccccataatacaaaaagcatcgcccctaatcattatttttcctaatcgtttagatcatataaatatattttactaatgattaagaccgcagtaaagtggagttatcaagataatgggaagtgactgagatgaagatgataaagggtatttcagttaccgcaggaattgcgtttgcggccttctatgtcagccgcctgccgtttttgcatatgctcggaatgcttgtccttgccatgctgatcggcatgctctggcgcgccgtattcggacagcgggcggcattagagccggggatcgcgttctcaagcaaatacttgctgaaagcaggcatcatcctgcttggcatgagactgaatctggcggatatctatcatgcgggctggcacgtatttgcaattgccgtctgctgtatgatgtttgcgggtgccgttgtatacggactgtcccggctgttccgtatagatcagacactcagcacgctgacagcctgcggcacagcgatctgcggggcggctgccattgccgcgatcgcgccgcagatcagatcaaatgaaaatgcagccgccgtcagcgcggccgccgtttcgttattaggaaccgtttttactgttgtatattctcttgcttatcatggattggggttttctcctgcggcttacggggccttttgcggggcaacgcttcacgaagtggcgcatgcggcggcggccggcagcgccggaggaaaagcagccgtcgagatggcggtgatcgtcaaactgacccgggtcgcgctgctcgtcccggccgcattcatgctcggaatgcgggcgcgccgcagcggaaagtcaaagacggcttctgccgcttcgctccccatcccttggtttatcttcggatttctcggaatgagcgccatccatacatcaggcgttatttcagcttcgttttccgcgtttcttgttcaagtgtcttatgttttaatcggcatggcgatggcgggtctcggtttgaaagtccatatatcggcgtttcgtcatagcggctggcgggcgctcgcagcaggcttgatcggttctctctgtttgtccctgttcggctgggccgcagtgacattctttctataaaaaaagccggtcctcgtaaagaccggcttttgcggattacagcgcttgagcagccgtaattaacgcaagattgtagacgtcttccgcattacatcctctggaaagatcgtttacaggcatattcaatccttgcagaatcggtccgaccgcttcaaagccgcctaagcgctgagcgattttgtagccgatgtttcctgcttcaaggcttgggaatacaaatacattcgcgtctcctttaatgtcggagtccggcgcttttttctccgcgacagacggcacaaatgcagcgtcgaattggaattcgccgtcaagcgtaagctcaggcgctttttccttcgcaattttcacggcttcagccactttgtccgtctcgtctgatttcgccgatccttttgtagagaagctgagcatggcaacgcgcgggtcaatgtcaaacatttgagccgtattggcgctttcaatggcgatttcggcaaggtcctggctgtcaggagcaatgttgatcgcgcaatcagcgaacacatactgctcgtcaccgcgggccatgatgaagacgcctgatgtttttttcacgccttcttttgttttgatgatttgcagtgcagggcgcaccgtatcggctgtagaatgtgcggctccgctgacaagtccgtccgcgagacctttgtacacaagcatcgtgccgaaatagttttcgtccagcaaagctttgcgggcctgttcttccgtcgctttgcctttgcggcgttctacgaaagcctgaacgagttcttccatgccttcatatgtatgcgggtcaaaaatgtccacgccgtcaagcgtaagatttaattctttcgcttttgcttgaatgtcttctttattgccgactacgatcggctttaataccttgttgcccgccaagttgttgaccgcaaccaggatacgttcgtccaacccttcaggaaatacgattttcacatcttttcctgcgactttttcttgtacttttgtaaataaatctgccacgatattccctcctctatgttgacaaaaaacgcttacttttacagcatactcttcttccagctaaattcaaataaccaacttctattatagcgctttcaaaaagaaatcttatttttctaactaatttaattgacggtttgtttcacggcttagtttctgacacaaggcttcggattattcaaggtttctccacagccgaaacggttaaactgtgatatagtgaaggcatcaatgtaatgaaaagatataggagtgaagatacatgagtgagcagcaaaaaacgaacgaagccgcccaaacacttgacggctggtacgcgcttcacgatttccgcacaatggactggacgtcatggaagatgttatccagcgatgagcgcctgtcgattattcacgaatttacgggactgcttgaaaaatggggcgtcgcccaaaaagaaggcaaaggctcgcaaaccatctacagcatcgtcggacagaaagctgatttcatgctgatgattcttcgcccgacaatggaagagctgaacgaaatcgagcttgaatttaacaaatcaaagcttgctgaatttacgatcccggcttactcttacgtgtccgtggttgagctgagcaactacctcgcaagcggagaaggcgatccgtatgaaaacccgcatgtccgcgcacgcctgtatcctgagctgccggaagcgaaatacgtctgcttctatccgatggataaaagaagaagcggcaacgacaactggtacatgctttctatggatgaacgcagaaacctgatgagaagccacggcttgatcggacggagctatgccggcaaagtcaaacagattatcacggggtctgtcggttttgacgattacgaatggggcgtcacgctcttcagcgatgatgtgcttcagttcaaaaaacttgtttatgaaatgcgctttgatgaagtcagcgcgcgctacggagaattcggttcattttttgtcggaaaccgcttgtctcttgacacgcttccgaagtttttgcacgtgtaacacccacccgcctgtccggcgggttttttctttgtcagaatttaaataaaatttgctatttttatcatttttttttacgatgtaaaggagattccattttggtaaaggggtgcagacagttgtcaaaacgaaccgcatttattatgggagccagccaggggatcggcaaagcgatcgctctgaaactggcggacaatggctttcataccgtcattaattcacgagttcccgaaaatatcgaatcggtaaaagaagagatcctcgccaaacatccggatgcgggcgtcaccgttctggccggcgatatgtcggaccagaaggcgagagccggcatttttgaagagatcagatcacaatgcggacggcttgatgtattgatcaacaacattccgggcggctcgccggatacctttgaaagctgcgatatagaggatatgacaaatacctttacgaataaaacgatcgcctatatcgactctatgaaaacggccgcagcgatcatgaaacagcacgaattcggcagaatcattaatatcgtcggaaacctatggaaagaacccggcgccaatatgtttaccaacagcatgatgaacgccgctttaattaatgccagcaaaaacatcgccattcagcttgcgccttttcacattactgtcaactgtctgaatcccggatttatcgccacagaccgttatcaccaattcgtaaagaatgtcatgaagcaaaacggcatttctaaagcggaagcggaggaacggattgcctcaggcgtcccgatgaagcgtgtcggaactgcggaagaaaccgcggcgctggctgcctttcttgcctctgaagaagcctcctatattaccggacagcaagtgtcagccgacggcggcagcatgaaaagcatataataaaaacatcccgctctcagcgggatgtttcttgtaatgaaggaaaggacaaacctagcttttgaatccgcagcacgaattcccttaaatcgccctgttttgccaccattgatattctgacataacgctttccgccgctgccgaaaatctcgccgggcgtcacgacaacatgggcatgctccagcagatagtccgaaaactggtgtgaagactcgaattcattcggaatttcagcccagacataaaaagtccctttcggtttttcaatgctccagcctaattccttttcacataacgccgtgaaaaaatcaatccgttctttatatgtgcgcttcagacgctccgtatgctcaggatttcctgacagcgccgccgctgccgcctgctgaaggccgccgaacatgccgacgaagacgtgatcctgaaactcattgaccgcctgaatgattttctcattccccacggcaaatgccattctccagcctgccatattgaaggttttcgaaaatgaataaagctccgcgccgaccgttttcgcttctttcgcctgaagaaagctggccgggttctgatcaaattcgaacgcgccgtatgcaaaatcgtgaataagatggatgtcatatttttttgcaaacgcagccgctttttcataaaacgcctgatccgcagtcgcgcccgtcgggttattcgggtaattcaaaaacatcagcttggcttttttcaggacggcgggatcaatccgctcaaaatccggcagatagccgttttccggatgaagcggcatctcatgcagctccgctctggccattgtgattcccgataaatactcagggtagccggggttcgggactaaggcgatatcgccggggttcagcaggcattgcgtcaaaacgtacaaacctgctttccctccgccgaacagcgcgacttctgtctccggattgaccgataccccgtactctctctcataaaattccgcgatggcttctttcagaaacggatagcctctgaaagggccgtatccgtgatatgaaggattcagcgcagcttcccgcaatgcttcaacgatatgcggcggagtggggagatcgggattcccctggccgagattaataatctgggctcccgttttctccatctcttttaccttttgaaaaacgagcgaaaattcctgtttcggaagtgtcttgatgacgtcggacggtatgatttccatctgaaaggctccttataaatgaatttgctctgattcgttattccgttctgaaaaggatttattgaccagttttgtatgcagaaacagcccgctgaccaaaaggacgataaacgccatgatgactgccgcgtctacaatgttgatcagcatggaaccggcggcgatgcacaatccgatggacgcctccgccaccgaaaagatccggccctgaatctggttcgccgcgttctcctgaactttgacctttgccagcacttcaccgtattccattgcgataaagaaaagaatggcggcaatgactgacacggcgaaaatcggggtaaacaaaaacagcgcaagcgagacgatcgataacactgtaaaatacatcagccctttattgttgttaaagccccatttgctgacaagagcggcgccgataaagccgccgaagccgatacagaacgtcaggatgaaattgccgatttccccgtcgcctaaaaagcggctgacaatcgggaaatagctgtagacgacaccccacaaaagcgccatcgtaatcatcgtgaacatggcgtttaacacaaaagcatttgttttgatttccttcaggccttctttaaacgactgaaaagcttctcttacgttttctgactgaatcggcacgtattgaagcttaatgcggctgatgaaaaacgcggagacaagataggtcaccccgttaaacgcgacggcaagctccacagaaccgcctaacagaaaaagtccgccggctgcagcgccgacaataattgaaatcgtcgtggcttttgcaaacaaagtgttgatatttttaatatccgcttctaaagacgacatgaccgcgagacgtgccgggttaaaaaacacgccgcttccgtacgagacaaacagcagcgccagaaaaagcagcggatattcgcctttcgggagaaatgtcagccccaaaaagatgacacctctgatcacatccgtccacagcatgattttcaccctgtcgagcctgtccacgagcacgcctaaaaacggctgaaacaccatcggaatgctgcggaccgcgataacgccggacgtcacccagtagtcatgatagtatgtagacaaaatgagcagggccgggagaacgcaatagtctcccataaacgaaagcgcctgcccgaaaagcaaatacttcgagttcggtttcagctgtttcataccggtaacgcatactttgcagtcagcttcgcctgctgctgaatttgtttgattgattcggccacgtcacccgaattgcttcctttcagctcaaacgccgcaatgctgttgaacgcttcgaacagccgcagatccacggatgtacccgcctcggcagccgagaaagaaacgagttcggtgtctccctttaagacgccgtcgggaatgtcaatgctttcaatgacgaaatcgacagctgtctcaggcagctggccgttctctttgaaatgctgaggatacaagtggcagtcggcgacataacatggctcctgctccaataatcctttcggcagatcggcttcttttccgaaacagagaacatccaataacagctgcgccatatcgacgccgaagacctttttaatattcggaatcatgttccagcccgcaaatcgcgccgctgattcaatcagtccggcttcccggtttttcattaatttaatttctgtatgtgtcgcgcagttttcgaggccgagtccttcattcgcctttttggcagcttcgacaattttccgctttgcgtcatcatccaggatggacggcgtaatatgcgatgtctccgtgaatccgatttgcggtgttttatcatgaatcgccacagggaagtattccccgtcggccatgatgccttctatgctgatatagtcggaataaccgcttgtttcgtaccagtcgtcatactcgccctgcaaaaattcttccgcgataaaaggcgcttcaaacgtgaccgctttcggtacgttaatcgacttcaggtattcattgactctgttaaattcagcttctgccgtttccctctctttgatgagcgtcacgccgatggagctcgccagatatgtaggcttcagaatgagcggcgttccgatttcctgaagcgcggcgcggaaatcttccagcgtcgtcacccgtttatttttgatggacttgacgccggcccggttgaaggcggctctcattttgtttttatctctggcattttcagcggcctgtacgcccgctccccgcaggccgagacgttcacacgcttttgccattggagcgataaacagttcattgttggtcgtaatggcgtcaaccccgaacatgtcagccaccttgacgatttcttcgacgacttcttcctcaggtttgtcatgatcttcatgagcccagtaaatcgaatcgggatgctcaaaatcagccagactcttaaaatagtctttatctttaatgaccgcaatcgagtatttttcaattaatgccgcatgagaggctgtaattgcaaaaggtctcggaataaagctgacgaggttgtatttttcggctgcgcttttgtaaaacatatgcggcgggcatcccccaaggtcagcgataaccaatactgtttttctctccatatgtaaacactccttctctattgtgcggtgtatccaccgtctgcggtgatcgcgcttccggtcatatagcttgataaatccgaagcgagaaacagcatgacgttcgctatttcttcaggcttgccgagtctcagcagcggattgactttcgctttttcttttttgatttcttcaagcgtgccttcgttgttttcaaggaacgacttttcattcaaaggtgtgtcaatgattcccgggcacacgcaattgacgcggatgttgtgtttggcgtaatcgacggccatcgaacgcgtcagctgcagtacgccgcctttagaggcgttatacgcgggaatgtcgggccatgcgacgactcctccgacggagcacgtgttaatgatattgcccttgccgcttttgagcatatacttgagcgcgtgcttgctcataataaacatgcccgtcagattgacgttgagcactttgtcccaatcgctcagctccatctcatgaatcggggcgacaatttcgatgccggcgttattgattaacacatccaatccgccgaacttgtcaaccgctgaccggatggcattttgacaggccggttcatctgtaatatccgtctgcacaaaatgcagcctgtcattgttttctttccggatcatcgcttctccctgcgcctcatcaatatccgcgacgaccacattcgcctcttgattcagaaacgcctgaaccgcggcataaccgatgcctgatgcgccccctgtgatgaggacggttttatccgtcaggttcatgactctttcgcctctaattttttcgcttttgctctgttatagcgcggagggaaaaagatattgactgattttgaatctttttcaaatctgttgatggcgccgtgatcttctctcggatcgcagaaataagctgtgccgaatgtcatatccactttgcagccttcaatggtcatatcatagccgccgccgatgcagatgccgatctgttcattgcggtgtttatggaacggcatttctcctccgttgcccggaatgttggcaagcatgatttccacccagtcttccacgaagaacgtgacttccatcccaggcaataagtctctcgttttaaaaatattcaaaaaataatcctcagggcttgtataggtttcaccggctttcaggcgtttaatatcaatggcgatcacttcttgatccgtctcatttcttgcgccgtgaggcacgttaggaggcgcgatataggctgattccagcgctgtcatctttcttgtgacatctccgacagtcatggacagctcgccggaaacgacaaggccgatttggacttccttatgctgatgcggttccacgtttgtatgcggcggaacgtaagaaagcagaacttccgtatcgcctctgacggacgaatattgtcttactccgttatcccattctattaatttaggcgtcgggaaataaagttcctgcaaatcttgttcagttttcatcatgaatctctccttttccgaataatgaccagctcatgggaatgcttttaaatgttttgacaaagtgaaggccgtacttttgtctggccagctcatttgtcagcgcgatgtcggacaaaccgtccttcactcttttcgcggctgcgctcgttgagttcaccagatcaaacgtgacatctttacgggtaaaatacttaatcaaattgataggagacgggtgggatacgatgacagtcttatcaagcatgtcatccgtatattcaaaaccgggccggacagccaggccgtacatcggggtgtcgcacctgaaaatttgcagaagctgcagatccggtctcatgtagaagtgcttaatgccgtcatacgcgtgaggcacaattgtgtattccagcggactttgaagcgttttttcaatgcacgattcaaatgtatcatgcaatgataatttgctgttcaccccttggagaagggtgaaattggtgatgaagttttttgctgcgtactcactgcttgtcccttcaggaccgagcgtgttgatcgtaatcagtttagatattgaataagccttgctttttgtttgaatgctattatccaatataatcatgagcaccaaccaatctgttaaattttaagtaaatattatccatagacgttcaagctgtcaatattatttgaaaatattgataattattcctatatattagaaaacaccttatgatataaggtgttaaaaatttacatttacaaaattatagaaactttattttaccgatacaatgattggtcggtcttatgctcatattttccataccttctgtatgcgaaaacgctgaggacaaagccgatgagggtgacggccgcacagataaatccgacagctgcatatccgtatccgacatagaccggacccatgacagcagaacccaaggtgacggccaaattggacgccagactgtaaaatgccatgattttgccccggcggctctgtgagcaatcacttaaaatagtgctgagcaaggtcaccgtcaggctttgcatcaatccccagacgaataacccgatgaccaaaaacggcattgatgacggcgcataggcgagacaggaaagccatatgctgatcacggccaatgccgcgatcaaagagcgcattttccccgccttatctgcgatttttccggtgaacacgctcatggaaaaaccgattccgtacaccatgatcagcagccctgaagctgtattcccacccggcatcacgcggtgaagatatgtaccgagaaaggaatacatgccgtaaaaaccgatcatgttgcaaaaagtgatcgtgagatatacagggacacggggcaccttcagcgcatcccggaaagtgcctgcctgccgtccgttttcctcttctgttttattcccatccgccgtgctgcggcgcgcctcaatgaaaatgagcgaagcaacgaggacagacatgagggcgaaaatccaaaacgtccaccgccaattcaaaacgccgccgataaaagagccgatcggaacgccgaaaatcaaagcgagcgaccagcttgacacgatcagacccatcaccttgccgcggtacgcataaggcacacggtcgccgaccaccgcatatgctgtcggcacaaacgcacccgctgcaagcccggaaagcgccctgcccagaaagaagaaaaagagattgtgcgccagcgcgcagatcaccgtgccggccgtaaatataagcagtcccgccagcagactgagttcccgggaatatttatctcccagcggaacgagaagcggcgccccgataaaaatcatcactccgtaaatactgatggaaagcgccagcacactgacatccgagctgaaagcccgcgctaaatccggaagcagcggagaaatcaccagctcttcagaacccgcggcaaatacccctaatgtcaaagcaagcgcgagacagaccggaaatcggcgtttcgtttcgatgtgatcggtttgtttgctgttcatgctctttgaacacctcttccgtaaaacttttctaccttttgttgttttatagtttagcatccttatatttcattttacatttcacatgaaaactaattctgattttttatttacattcatattttaaataaaatatttagtttatattcaataaatgatataaaatacgccgtctggttatgctatagtgatagaatcatttgttaaggtgggggtcatgaaatgaataacgctgattcaaaggccgcccgcgcaggcctcggcatggtactgattctcgggacgctcgcttcattcgggccgctttcgctcgatatgtatctgcccgctttgcctgaagtggcggccgatcttcatacgacagcgtcacttgcgcagctgagcctgacgttttgtcttttgggtctggctgtcgggcagatcgttgtcgggccgctcagtgatatgatcgggcgccggaagccgctgattctgtcattgctgctttatacgctgtcttctttattatgcgccttcagcccttctgtttcgtttttaattgtcatgaggtttattcaaggtttcaccggggcggccggaatcgtcatcgcacgggcttccgcacgcgatatgtattccggaaaagaattgacggcttttttctcattactgatgctcgtcaatggggcggcgccgattttagcgccgattacagggggatttatccttcagttcgccggctggaaaatcgtatttatcgtgctggcggtaatcggctgtatcatttctgccgccgtgcttacggtgttgcctgaatcactcccgccggaaaagcggacaagcggcggactccgggagacgctgatgacgtttcgcggcctgcttggcgaccggatgtttatgggatttgcgctcagccaggcatttgtgatgaccggcatgttcgcatatattgccgggtcgccgtttatactgcaaaacatctacggcgtatcggcccaaatgttcagcctgctgttcgccgtaaacggtgcgggaatcatatgcgccacccaaatcaccggacggatggccaaaacacatgatgaacggaagctgtttgtctccggtctgatgattgccgtcatcgggagcatcgctttgcttttatcacttgcgtttggtttaggcctggcggcagtctgcatttctttattcatcattgtttcttctgtcgggatcgtcacgacgacgggattttctttggctatgcagaaacaggagaaaggcgcgggaagcgctgcggctcttctcggactcctgccctttatcggcggtgcggctgccgctccccttgtcggtattgccggagaagaaaatgcctggccgatggccgtcagcattttcggttttcagttctgtgccgttctatcctatgttctgtcggccaaacgaaacacaaagtaaagcccgccgctttaagcgaagggctttttttcttatccggcagcgcctttttccgaagaagccggctcacgcttcaggcgttttttgataccgaagtgataatacgcgtaacagatgatcatcagcgggacaccgcagtacagaccgatacgctggtcggggataaagatgagactgattaagataagaccgtaaaccgaaaatccgagaatcggcacgatcggataaagaggcgttttaaatgccaggtccttcagatttcctccttcagcgagaaagcgtctccggaaaacgaattgtgaagcgcagattgacatccacgcgacgacggtaatcataccggagatggaaatgagccacacatacaccgtttcagccgcgactacacttgtcagcagggataaaccggagatggcgatggtgatgaaaagagctttcagaggcacgccttttttcgtcagtttcgttaaggaagcggggcccatcttagtttttgacagggaccacatcattctggacgaagcgtacagcccggaattcgccaccgacagcatggcggtcagaatgacaaagttcatgatatcagccgcataaggaacgccgattttatccagcacagccacaaacgggctttcgatgacgcctgccgtttgatacggcaaaatggacacgagaacaaacatcgccagcacgaagaaaaaaagcgtccgccatatgacgtttcggatcgagcggggaagcgtcttttccggattttcgctttctcccgaggcgattccgaccagttcggtaccctggaatgaaaaattcaccataacaagggtaaacagcacggcttgggcgccgttcggaaaaagccctttgtccgtcgtaaagtttgacagatacggagccgtctgcccgccgttaaaaccgacaaagccgaataccgcagcgcagccgagaataataaacaatacaatggccatgaccttaatgctggaaaaccaaaattccatttccgcaaaactccgcgcagacagcgcgttaatggaaaaaatgacgacgccaaataccaggcaccacacccaaatcggaacggccggaaaccatcgctgcattaaaatccccgccgacgtcagctcaagccccactgtattggcccagctgaatgcgtacatccatccgatcgtaaatcccgtcgacggcccgagaaactttgcggcatacgcctgaaatgatcctgcgaccggcatggcaaccgcgagctcccccaaacaaagcatcaccaggtacattaaaaatccgccgatcacataagccaatatcgcgccgatcggtcccgcttcactgatcgtaaaaccggagcccagaaaaagccccgtcccgatcacgccgccgagggcgatcataaacaaatgccggcccttcatcgtgcgctgcaattcattttgattggtatctccctgcatatacatcccccttattccgttatgtcagccatttgtgcgtatgtctaatcggcagctgtgcaaaaggtgcattgtcgtctgctgaatgagttccggcagcacatggaatgtgtacggtttgtacacgcgttccgtccatttatggccgtcctttccgtatacccctatattgaccgacggaatattcaattccctgatttcattaaaaggaatcgtcccgatgacatcccagcccggaaaattatcggtaaaggcggagacctcctcatctgtttcatgcagcgataaaaagcttccgtccgccaaataagggaaaaactttttaaagacgaatgtttctccggttgatgccgctgttttatcgaccgcttcttgaatgacatgctgcaaaagccggtcccgtgtgctttcttccttcagataattgtgcggaaggtaaggcggcgcatagaaaataatgaccttggctccctgctcaggatcgagtttttgcagttcttcgacggctttaaaacatctcatccgcagttcaagatgttcatatgttttaaatgcctgcccgatacactgtgcagggtctatcccgcggcttctcagccttttcaggtaatcttccagactgtacacttgaacgttccatgacatctcttttttcggcaggctcgttctctcacagtattcgtcgtaataatcagataatttttgttctgtctctttgcaggcttcgtcagccacggcggtcagctgatccatgacttctttggcggttttctcgtaaataaaataattaaaatagacatagctgctgacggcggtctgcacgttatacgcttccttattgtcacgctggtagaggcaggtcggcggaagcacaagctccccttcaatgttttccgccatatgaatattgttgtgaattcttctggtgatttctgacgcgatcaaattcggatcgatgccggacagcgtatctccgacatgcacctcccgcccgtaaatcgcaaagcaaggcaaaagcttccctgccgcacccgtgtatatgtaccttgtcgtgtcaccctcatacagcggcgtgataaaatcgttattaattgctgctaaataacgaagctgcttttcttgtttcagccgttttaattcagaaatgctggttaaaatgccggaatgctggctttcttcatccgggtttgccatgaacagaatatggcccggcagctgatcgcgccgttcagaaaagtgaagcagattggcgagatgaacggcaataccgctctgcatatcaaccgaaccccttccgaacatccactcgcctgagcgggcgtcccgctgcacatcccgatcaaattcatagtttgagaaatattccgcgagacggtcggaatcaaaagcgatatcttttaaagggccgaaatcctcgatgccgaccgtatcaagatgagcgtgataaatgaccgtattcaggctttcgccgtttccctcaataaatgcgaaaatatttttgcggccgtaagggtcctcaggaatcgcctgctcccacacatgtgacggattctcctgaaagtagggaaagctcttgatcatatctttgatatagtcggctttttttccttctcccaatgtgccgttgatgctgtttaacgccaccagtgatttcgtaatggcttctattttctcctccggaagcattttgctgagctgctgatacatgttccatcccccttaccctcatatagagaaaatagcgcgactctctttttcatcgcgctatttccgaaagattaataggcttcagacgttgtttttgcctgcatatgaagaatcagatagtcaggtcctccggctttcgaatcggttcctgacatattgaagccgccgaacggctggtatccgacaatcgctcccgtacagccgcggttgaagtatagatttccgacgtgaaaatcttcgcgggcgcgttcaatgtgcgcgcgggtttttgataacagagcgcccgtcagtccgtaatcggtattattagcaatctcaagcatatggtcgaaatcacgggcttttgagatcgcgacgaccggcccgaaaatttcctcctgcatcaggcgggcgttttcatcaacatccgcaaaaatggtcggctgaataaagtatccttttgaatcatcaccttcgcctcccgtcaggagttttccttctgttttgccgatttcgatataactcatgactttattataagatgcttcgtggatgactggccccatgtatgtatcaaaatcttccggacttccgacggtgagtgattttgttaaagcgacggctttttcaacaacttcatcatagacgtcctgatgaatgaccgcgcgcgaaccggctgaacatttttggcctgagaatccgaaggcggaatacacgattgaggaagcggcaagatcaagatcagcatctctgtctacaagcaccgtatctttccctcccatttcggcaatgacccgtttcagccacttttggcccggctgtacttttgcggcgcgttcatagatgcggcatccgaccgcgcgggagcctgtaaacgacacaaatctcgtcttcggatgctcaaccagatagtcgccgatttctcctccgtcgcccggtatgaattggagcacgccgtccggcagacccgcttctttcatcacttctacgaatttcgccgccacgacaggcgccgcatccgccggtttcagcagtatcgtgttgcctgttacgatggcggctgccgccgttcccgccatgatcgcaagcgggaagttgaatggagaaatgacaattcccaccccaagcggctcatagtgatactgattatattctccgtcacggctctttacaggagaaccgtctttcagcttcagcatctgacgggcgtaatactctaaaaagtcgatcgcttccgccgtatccgcatccgcttccttccacggtttccccgcttctttcaccaggtacgcggagaattcgtgctttcttctgcggatgatcgccgccgccttaaacagcacattcgcgcggtgttccggccgtacttttttccatgtttgaaatgcctgcagcgcagcctgcatggccttttccgcaagttcttttccggctgccgatacagaaccgatcacttcttttttatctgccggattgacggaaatgatctttttatccgtttcaatcgcttcaccgttgatgataagcggataatgcttgccgagctgtgaattcacataagccagcgcttcctgaaacgattgtttatttatctcttcctgaaaatttgtaaatggttcgtgtgcgtatgaaactgtcattagaattcctccccgtattttgtaatgtgtgctcacgcttaatgaagatgcaagaagcataccagcatagcaatttgtgatcaaaaaaagaaaatctttgccgaaagcggacgaagcttgtccgaacctgtcagctgcaatctgaaaacgcaaagaaattttgcgatccgctatataactgatgcaaaatctctttgcggataacacttatacccagccgcggaaccgggccgcttcagccgactttctgatgcccgtcatataggcggccaaacgcatatcgactttgtgggtatgcgctgtctgataaatggattcaaatgaattcaccatgacgctgcgcagttttccggcgacttcttcctcagaccagtaaaagccttgattattttgcacccattcaaaataagacaccgtcacgccgccggcgcttgccaaaatgtccggcacgagaagcacgcctctttcattcaggattttcgtggcgtctatcgttgtcgggccgttcgccgcctccacaatgattgaggctttaatgtgatgggcgttttcagccgttatctgattggagattgcggcaggcacgagaatatcacagtccttttccagcagctcccggttcgttatgacatcagagaagagattcgtcaccgtgccgaagctgtcccgcttatccagcaggtaatcaatgtcaaggccgtcagggtcatacaaagccccgtgggcgtctgagatgccgatcaccttggcgccggcgtcatgcataaatttagcgagaaagctccccgcgtttccgaacccctgaatgatgatccgcgcattttccaacggaatcccttttttcttaacggcttcctcaatacaaatcgtgacaccttgcgcggtcgccgtctcccgcccctgtgaaccgccgagaacaatcggtttgcccgtaatgaatcccggtgaatcaaattctctcaggcggctgtattcgtccatcatccatgccataatctgcgagttggtatatacgtcgggagccggaatatcctttgtcgggccgacgatctggctgatcgcgcgcacatatccgcggctcagccgttccagctctccgaatgacatcgtccgcggatcacagatgatgccgccttttccgcccccgtaaggaagatttgtgatgccgcattttaaagtcatccagatggaaagcgccttaacctcttcttcactgacttccgggtgaaaccgcacgcccccttttgtcgggccgactgcgtcattatgctgtgagcggtagcccgtgaaaacctgtactgagccattgtccattttgacgggaatgcgtacggtcaaaagccgcatcggctctttcatcagttcatacatattgtcaggatagcccagtttgcgcagggcttcttttatgatcgattgtgtggacaagaacaaattaagaacttctttttcttcatctttctgattgcttttagaacgcgggttggctgacatgttttatcacctcatcgtattttacgtgtaagcttcaattaccggcagaacgaaatgtaagcgcttttacaccaaaacccatcaatccctttcacattgtcgttacacccctttttatatgcaagattcatgccaggattttgcgcataaaaaaagaggctgttgtcagcctctttcatcccggattaacgcgggtcaataaccagctttgtttcggcatagagactgccggcccccaaaccgtttacgtaatcgcctttaattgtatacgtgcccgcgcgcggaaggtttttacgcaccaggacgagattgtattcagacgcgcccaataagtcaagggtaagcggaagtctgaccgtttttccgtagttgagaatttgcgtttctttcagtgttcttccgtttacagagtccctcacagtggcgttgaacccgtcaggaaattgaaattcaacggccccgacggcaagcagcgcattcggcttgtatgtgacttcaatatcagacgtcgcgtattctttcgtactattgacggttttcgcttcaataacggcagattgggcgttcgcatgaaaagatggcaagaacacagctgaaaataccgcagcactgatgagaaaggcagaaaatgattttctttttaacatcatgaattcctccagatcatataggattcagagcgtcctctgccggaaaagcgtgtctgatgattccattcgcgaattgggtttctcttttcctgagaataatctaccacctttatccatggaagtaaattattttttggaatattcaatcatttatttttcacgagatgaatcagcacaaaaaacgaagacatccgctgtcttcgtcttgtgcgctaccggtgagccgtctgccagtcaaatccgatggtgtcatcattccacgggattcttttttcgtcaggctgatccggattgtaggacattgtcgtgaaataaataatggtcagcggggtttcgcccagcactctgtacccgtgtgcgacgcctttgggaatgagaaggagcatcggattgtcttctcccatgtagtagacatccgtttctcccttggttgccgactcttcgcgaaggtcatgcagcacgacctgggcgtggcccgtcgggaaaaaccacaggtcatcctgtttctcatgatagtgaaacgctttaatgacgccgggatagcttttggaccaggaagcctgcccgaaacgctctaagagatgttcatcgtcacggacgagttctgagaaaaaaccccggtcatcgctgtgtttgatcagctttttaatttttacgccttcgatcacttgcactgtccctccctttgtaaataatcctgcagcgcttcccgccaatgcctcatgccgagcccctgccgttcaatcgactcaaggctcaacaccgagtaagcggggcgcggcgtctcatttccgtattcctccgtcgtgacgggcagcacggcggcggttctgccgctttcttcaaaaatagccttggcaaattcataccagctgcacactccgctgtttgcggcgtggtacaagcccggcggcctgtcaaacagaccgatcaccgtttcggctaaatcttttgtgtacgtcggtgcgccgacttgatcgttaacgacacgaacctgatcatgtgtatccgcaagtttcagcatcgtattgacaaagttgtgcccgccgctgccgtacacccacgacgttctgataatggtgtggttttttcccgttaaccggatcagttcttcgccgagttttttgctttttccgtaaatcgtgcccggatctgcgggatcatcggtctggtatggccgtgttcctttgccgctgaagacgtaatcggtgctgatgtgaatgaatttcgcgccggtgttttcagcctcaagcgcggcataataagcgccgattccgtttattaaatacgctttgtcgagctccgtttcacatttgtcaacggaggtgtatgccgccgtattgacgacgatatccggcttgtaatggctgaacgagtgccgcaccgaacgctggtcggatatgttcatcatcgcttttgtcaaggcgatcacttcatacccttcccgcttcagctggcggcataactcccgccccagctgaccggccgctccggttactaataccttcgtcaatcggatccccttctttccgattagtcttggctgtctgtataccagcgaatggttcttctcattccttcttcaaatgtgacgtcctgccgccatcccagctcatttttcagctttgaagcattgatggcgtaacggcggtcatgcccttttctgtcttcgacatgagcaaaccgttcctcgacaccgagctccttcatgataaatgacgcaagctctttattcgtccgttcatttcctccgccgatattgtaaatttcgcctagtgttcctttttccagcacgagcttaatggcgcggcaatgatcttcggcaaacagccagtctctgatctgcatcccgtcgccgtacagcggaaccggcgtgccgtttacggcatgcctgataatggtcggaatcattttctcgtggtgctggtacggcccgtaattgttgctgcatctcgtaatgatggcaggaagcttatgggttttcacataagacatgacaagcaggtctgagcttgccttgctggcggaatacggattgttcggagaaagcggcgtcgtctctgtaaaagcgggatcatccggcgccaaatctccgtacacctcatctgtggaaatgtgaatcagcctgccggcttttccctgtaacaccgcgtcggccagtcggtatgtgcccatcacatttgttgtgatgaacggctctgcctgatttatgcttctgtccacatgggattcagccgcaaaatgaatgacagcgtcatacatttgggaaaagactttgtcaatgtcctctttttcagaaatgtcacctttgataaaacggaaacggccgttcttttttaaggcttctatttcaagcggcctgcttgcatacgtgagattatccaggacggtaatctgcgcatctgtttctttcagcatcatctttgtgaaggtaaggccgataaatccggcgccccctgtaattaaatatgattttggcatgattaatgctcctgtcctttctgtaatgcctgatgcgccaggcttccggcgagatagagcgattcatgcgtgcccgcatccacccaccagcccgttaacacatcatacgtcagctcactgtgttcaatgtataaattattgacatccgtaatttccagttcgccgcgttttgaaggagaaatttgttcaatataagaaaacacttctgcgtcgtacatgtagatccccgtgacgcatagtctggtcggcggctgctccggcttttcaatgatcgacttgatccgtttgttttcctcatcaatctcggcgatgccgaagcgctccggatcgtcaacttctttcagcagcactttcgctccttttccctgctttgcgaaacgctccgtataaggttttaatgaatcttcaaaaatattatctcccaaaagcagaacgaacggatcgcgcccggtaaaccgctttgcgtatgataaaccgtcggaaatgccggatgcggctggctgaacctgatatgtgattgagacgccgagctcttctccggtttcgagaagtttatgaaattgcggaatatattctttttgcgtaatcagcaagatatccgtaatccccgcttcttccagcttcatgatcgaccagtaaatcatcggatatggaccgacagggagtaaatgcttattgaccgcttttgtcagcggcataaggcgtgagccggtgcctccggctaagataacacctttcacatgaacacttccttacgtgtggttttatcacaaatcataaagaatcgccgccgcccgtttaatgcccctgccgtcaaccagcggctttccgttctgatgaagcccgagccgtctcggataatcagcagccagctcagacatatgccgagcgagcacgtccgccgcggtgtgttctcccaggccgagatgaacggcggcctctcgtgcggcgaatttttccgccgtctcagtttgatgctccacttgagaaagaacgatgcagggcacacctgtacaaatggtctcatataaggtgatcccgccggacacgatggccatatcagccctcgtgagaagcgcggccatgtcatttgtctgccttaccatctcggcataaggcatttgtgtgagatgcgcgcgcacgtcatcagcatgaggcgccgcgccgcccatgacgatgatcactcgtttccgctgaatatcagggatgcggcggcatgcttccatcactttaaagacaagcttcttcgggtcgcttcctcctaaagagaccaatatggttcggcattcttttctcagctgatagagctgctttgctttttcaaaacccggatgaagaatcatataatccgggccttcatataccgcggcgctgcccatttgaaccgtccggcttttcagcccgccgtaaatgccgtttataacggcatcgcataaatgaatgacatgttccctcttttcttcaaataagacgatacgagccgatgaatgctttttgatttcctccagccagtcacacggcatatcgagcagatcgaatatgagaaggtcgggagcccgcgtgtttatttcccggacaataaattccttctgtcccttgtcaggcttgatgatcacttcccattgatcagatgatagataagaagaagcctctttatttgtgtagaacgttattgagcagttgttcttaatggcaccggcaagcagcttcatccgaaccgcgtgccccatgccgatgtcacggcccccgtccgcgaaaatcaaaacccgcacgctaatcagcctctttttgccggatcatttgattaatggccctgagctccggatcacgattcagcagatggatcaattcttttgccggaatatcaggacgcgagcccgcttttacgtacagctcgcgggccagcctgtagtcctcttctgtatcgacggtcatccgcaagtgaggagcccggagttcctgcgggggctcaggaaagagaagccggtacctctcaggggattctcttatcaaaagggtgacatgctcctgatatttgtccgccagcgttttgtccgcattgatctccgttaaaaggcgcgcgttcaccgcctcgccgccgatcccgagcggtgtaccgcagatatacgtgtagtctgcgtgctgatctaaatgcgattgaatcagaaaatcaagcagcgaagggtcgacaaacgggttatcccccgtcagtctgactgcgatgtccggttttacttgttcgatgacttgtgcaaaccggtcaagcacacgctgttcgctgccgcggtggacacggtagcggttgctgaggcagtgcgcagacagaatgtcgtcggtcttgctgtcagacgcggcgacgatcagattatcccgtgattgatcgtaaaacgcactttgacgaacccttttgacaatcatatcgaggatcgtatacccgccgatcggtttcagcactttgccgggaagacgcccgcttcccatccgcgcctgaatgataaacaaaatgtcagtcatcatatgggctgcctttcgtcaaaaggtcatcccaagtgatgcccgtgtcggcggggatatccctgaccgcacgcgcgccgtcagttaaaagctcaaaatatctcgggtgaagcccctgcggtttttggccgggacgaaggacggcaaggttttccgccgtaaaatattcgcctttttgaatcggcgctgttgaaaaaatgcctctgtaagcaaaccttctgatatccccttcaatcggtgtcgtcgttttatgggagcttcccgacagcacttccggcaccggagcgtgatgcccctgccgcagctccgcttcaactgagcggatcgccgcaaccatttcttttaattcatccggattgagggcgaaggagtgatcagcaccgggcaggtttttatcgatcgtaaaatgcttttcaatcagtttcgctccgagcctgacagccgcgcacggcacatcatacggatgggcgctgtgatcggagaaaccgatcacagcatccgggaatgcggcggcaagcatgggaatgacgctcagattgctgtattcaggcggcgcgggatatttcgccacacaatgcatgatcgcaatttctttgttcccctcgccggtaatggtttgataagcctcctgaatatctgaaatatcagcgcccgcggtggaaaagataatcggggtcttcagccccgcgacatatttcaataacggcagatggttcagctcgtaggaggcgattttaaaagctgaaggggaagtcgcatacagtaagtcggcagagccttcgtcacataccgtgcttaaaaacagcacgccttttttcttacaatattcaagcagcggttcgatccactcagcgggcatttccattgattgcaccaaagaaaaaatagagacgttttttcccgcagcggttttgtataagccggggtctttctgatacattttgtcagcctgaaacatttggaacttgaccgcatccgcgccggcctcactggccgcatctatcaattcaaacgcctggctcagttttccgtcatgattaattccggcttcggcgatgatgaatacgggcgaaccttcgccgattgacttcgttccgattttgcatgatgccatcagtccgcctccttcccgggccacacatgatagtagtaaaaggacgcatccgctttaaatcccattctttcatacaggcggatggctcttacattgtggagctgcgttcccgctgatacagtcttatgctgaaagcgcaatgattgttcaatcacgtgcgcagctaaatggaatcccgctccttttccttcaaatcccggctttaccgccatcagatcaaggacgaattcatcgcctttagacagcccctgaacaaagcccgcggtctctcccttatatttggcgaggaattgtaacgaagctctgccttccgcgttattccgcgcccactcttcaaacagacggtttgcacttttatagctgagatgggggtcctgataatacctgctttttgtaaaggcgtcgcgggccagccggctgatcgcttccgtgtcgccgggtccggcttctgtaatctcaaacggcggcgtgctgttatatacacgcaccggactgacgagcttgagaagactccctacaaaataagcgttcggaagcgactgcacgacctgcatcgcgccgatatcttcagctggtattttaataaatataaaatcagtgccgtccgcccgccttgccgcgtaaaattcctgaaacagccttttgagctgtccggtgctgtttgcggctgcaagcttcacattgatgatattttttcggaacaattgactttcccacgaagagttttcatataaaatcacgccttgaaggctgttttcttccaataaacagagcgacgattcataggcttcgggctgaatgcccttctgatgcaggaaggcatgaatcatgtcctgtgcaagattttctctcagtctgtacacctaatcagcccctttgacgatatccgtaacggctgcaatgacgtattcaacgtcatcatctgtcattgacggataaagagggagtgatacggtgcggtgataatacgcggccgcggccggaaaatcagtttccttatatccgtacgttttttgataatacggatggaacggaaccggaataaaatgaacacttgtgccgatattatattggtctttcaaagcggaaatcagatcgttccggctgatcccggcctcctgctcctctatttgaagaacatacagatgccatgcatgccgcccgtcatcactgacatatgggacggtgagccctttcatgtctctgaaagcgtcctggtagcggctagcaatttcagcccttctttgctgcatgctgtcaatccgtttcagctgatgaagcccaagcgctgcctgaagatcaaacatattcattttatagccgggcgtttcgacctcgtagtaccagcttccgtttgaagaatagcggttccacgcgcctttgctcatgccgtgaaggctgagcaccctgatctgatcggcaagcccgtcatcgtccgtcgtcagcatgccgccttcaccggttgccaggttttttgtcgcgtagaagctgaatgccgtcgcatcaccgattgatccgatcattttctgtttataagtggtatacacggcatgtgcggcatcctctaagacaaataactgatgcttttcggcaatggccaaaatttgatccatatcacacgactgcccggcgaaatgaacgggtacaatcgcttttgtccgcggggtgacggccgcctcaattttttcagggtctgcattcagcgtaagcggatcgatgtcagcaaacaccggaacggcgcctgtgtgcacgattgtattggctgttgaactgaacgtcacggcagacgtgatgacctcgtcgccgggaccgatccctttcgctttcagggccaaaaacaaagcggcggtacatgagttcagcgcgatcgcatgctttgcccccgtccaggcggcaaaggctttttcaaacgcctctactttcggtccctttgaaagccagcccgattcaagtgtatcaataacctcctgaatttcgtccttcccgatcatgggcaatgaatagggaagaaaagctgatcttttttgcaccattttttttgcgctcctatcttttttatgaagggtcaacccgtctgaagctgactccggttttttcctgaagcacttgacataaagcggcaagcgaatcctgaaccgggtagttcgcggcgacaaaagcacggcgcgcctgttccgctttttgatattctgcggggctttcgcatatccggattaattcctgagcgagtgcctgcgggtcctcaaaaacaaattctccaagtgaatgataataagggtatcggcgggttcccgctgattttccgatcagcacgggcttttgaaacagcatcgcttcaagaccgaccgttgatgtctgtgtcaccgcagcgtcaacaaacgggagaatatcatacagctccatctcttttttgatgattttgcctgctttatatttccgcagcacctgattgtaagcatccagcttgtttttgccgatttcccacggatgcggtttaataatgagctgcatgttcttttggccggcaagctcttcaagcactcccgtataaaattcatcagaaaacggctgcgtggcgatcagcaccgtccgctgtgacgggagaaaagaaagtttgcggtaaaacgtgtcccgatctatcggctctcttgagaaaatctcgtcgaaacggggatgccccgtgatgatgatttgttcctccctgcagccttttgctttataccactccgcttcataagccccgaatacagcctgatagtccgtaaatacgggcagaaacgcttcatctcccatgagcgccccgtgctgaagacagatgctgacggcgttttttttcgcggacatcagcgccagcacacggctgtaaatatcctccgtcgtgccgactacaacggcggaaatcttctcggccgtaaacaaaatatcaacggcgtcaatcgcttcaataaataacgggatgtctttatacagtcgttcctgaaattctctgtttccgaaagcgggatggctgtgaagctctttcaaaatggaatgggctttttcaatataagggacggggttccctttttgccccattcccgtcagctccaatttgcagataacgggcagcccatgatggtcaggcagactccatctggccagtaccgctgtttttgccggatcaaactgccggtaatttccctcggtgaaccgaagatgatcgaaatgcagaatgacttttccgtttaccggtttctcatctgttttcttaatgttttgccttttttgatcataataaggctgaataccggcttcaggaatatgctgatccgccggaccgaaaagctccgggttctgctccatgctctcccgaagcgccggactgatatattgataaaaattactgatcaatgcgagcgggatgtctttgtagcgaagtgactgaaaaaggtcaatatactgccggtacagcacccaatagttcgctaagtatgccgacaagccctcacccctttccaagcttttttaatgattccctcagctcccggcacgtggtctgctgcggaaggctgttcacaaactcgtttttctccgccgcgaaaagctgataatggatggattgatcggtaatataattgatatcaagttcctcagaaatcgggtaaaacggataaaaatgattcactctccagaaaaaacgggcgtcaccgatacggtaaaacgcggggctttcatcccaataggaaccgaatgccgatttgacctgttccagcacggaaaaccggtgcatgaccgaacaatggtcaatggcgcacggcgcgttccacacgatccgttcggcgggcctggccgtctccttcaccgtctctttccgctgattcagatgataggttttggaacttgaatacacgacggctttttccgggtcttcatcaagctctttcaccattttctcaagccgttccggcacatacgtgttgtcgtcggtcgcatacgtcacgtactcgccctccgccatttctattgcctgattaatcaaggcggcgtagcgtgttttttccgttctttctttgacgcccgatacatcgctttgataaaaccggacgcggtcatccgtgagaaaaggacgtatttccgccaatgtctcttcatttgagttgtcatccataatgaacagctcaaagtccgtaaacgtctgagacagaatacttttaatagagcgggccacatagtcacttttgttatagctcgtcatgatcactgacactttaggcaactcgtcacccccttttcgcacctgaaactaccgctatcatatgttccttatgcggaagatgcgctagggatacagactattatgtgaaaagtcagcattgcgcgcacaaaaaaagccggctctgatatccggaaacattggatcgtattttcttttttcgcataaatctttctttgggctcatatggtggaatagataaaaacagcagccgctctgtcggctgtctgatacttgtcaggaggtttcagcatcaagaggttttcatcaaaggaggaacaatatgaaaccgaaaaagaatcaatatcagcaaatgcaggggatggggatgggaatggatatgcagggattccagccgcagctcgggcctaatccttatccgcagcctcagggccaaggatcacaaatgatgccgatgcagcagcaaatgacaatgccgatgcagcaaggccagcagggcttcggcggggggttccccggccagccgcagcagcagggcggcggcagctttcaaatcccgtcaggtccatcatcgtcacaaaacgttcccggcatgctgccgattgaagagtcatacattgaaaatattctgcggttgaaccggggcaaaacggcgacgatttatatgacattcgaaaacagcaaagaatggaattcaaagattttccgcggtgtgattgaggcggcgggacgtgaccatatcatcatcagcgatccgaaaacgggcacccgctatctgcttctgaccatttaccttgattacatcacatttgatgaggaaatcgcttatacttatccgtactccatgtcttcttattctccgagataaatcaaaaagccaatcgctcacttgacagaggattggctttttttctttataaatatttgacggccgcgacgataatcataatccaagagatgataaacgccacgccgccgagcggtgtaatcgcgccgagaatggaaatctgcgtcacgctcaatacgtacaggcttcctgaaaacagaacgatgcccgcaaacatcagccagcccgcaacagaaacactgcctgcgccagagagcttttcagccaaaaacgcgacagccagaagaccgagcgcgtgatacatatgatattgcacgcctgtgtgccacacctgcaaatatttatcggggattttcccttcaagcccatgcgcgccgaaagcgcccagcgccacggccaataaagcgttaatcgcaccaagaataataaacactttcatctatttttctcccgccttttcgttaaagtttccaattcaatcataacccaacatcggcaaaattcaacgtccgtcatccgatgacacgagattgtcggattttttctttttgataagctggattcggtcaatcgctatcgccagcagcgttccgagcacaaggccgttgcttaagagcgaaatcaggatcggatgcatccctgataacgcgctctccggcacaaacattacgccgacccccgtgaggagcgccagaccgataatggaacggattcgtttttgctccgctttctcataagagtcaaactccgtaaaggcaagacccgccatcgtggagaaaacgacgaagtttaccgcaaagccgaccggtgagggcagactcgcaaacgcattcataaatagcgggatcatactgatgatcatgacaaatacacttcccaaaagaaacggctttttcgaaggaagcttcgtcgtctcaataaaaccggccgcccctgaaatcggcacaggcgcaatgccccctgacagcccgctcaaaaggtggctgatcgaagccgcaaaccctgccggacgctcacgccgtttcccaacggtgccgccgaattttttcaccgccgcttctacaacccggatgctcgcgagcatgttgacaatcaaaagcacggtaatgaagagtgacgtaatgatcaggccgctgtcaaacacgggttttccaaacggaaaaagaaccggcagctgaatcacgcgatccggtatttgaatcggtttggcagcgccgaagacggcgaataagatccatccgccggcaagcgaaaggagaatcgcatactgtcttaagaacgtaacattcgatcgggacatgatgaacatcgccgccgtcacaaccattgcgagcccgaatacaaggccgtcgacgctgttttttaaatagccgatgcccaaaaggcctttcacaatcggctgactcagctgcatgaccaacagcagcagatacacaccggtcacaaccggcgtaaacagcacggccagccgttcaatcactttaaaaaggctgaacaaaaagaaaaagacagcgcttaataacagcgccccctgcagcgcccgcagcgtctcgccgaatgtcgcaaacaccgtgcccgtcagtccgccgtaaatcgtgtatacgccccaccataagcctgccgggctttcattaatcggcagacgatgtccctggagacattggatgaccgcagcgacgccaagcacaaaaaatgtgctctgaatcaatgcggcagaatcggcatggttcaagtgaaatgattgtgcgatggcgacaggaactacaatcgcagccgcaatcataaatgccgtccattgcaaacccccgagtatcagtttcaagtcaatcaacctctcctgttaaaaatcgaaaatggaatccccgtttccgtcttcctcacgttcgtctttcgcttttttctgatattggttcagcccggcgctgcccatcattttttcaagcagcagcgggtctgtcgaaggagacgcggaaggtttcggcgccgctttcggaatcggattctgcacaggcgccggagcggtgtgcgtctgagtgccgagcacgacatcacacagagagcggatggcggccgcgtgcattttgacctcctcggtgcgggtcgccgttttcgcctgcctcagttcttcttccatcttctgaattaaagcagagatatgtatgttcatgagtaaatcctccagcagtaatttgtcttcttcctgcattttatcaaatttctgagcggatcgcagaattgagtttgttattttttctgacggcataccgcccggaacatcaaaaaagacgcttccgccgggcggaagcgcctcaaaaaaccgtttattgcggcaggtcggggatgcaccaatcgatcggctgctcccccattttttcaagggcggcgtttgtacgggaaaacggtctgctcccgaaaaaaccgttccttgccgaaaacgggctcggatgagtcgattcaataataatgtgtttcgatgtgtcaatgcgctcttttttcatctgcgcgtgacgcccccacaggataaagacaatcggcttctctctttcattcaccacatcaatgatgcggtcagtgagccgctcccaccccttgcctttgtgggaattggcctgaccgcggcgaaccgtaagcactgtgtttaacaaaagcactccctgcttcgcccagctgacgagcgatccgtggttcggtacggggcagccgatatcgtcctgaagctctatgaaaatatttttcaaagacggcggctgtctgaccccgggctgaacggaaaaactaagcccgtgcgcctgtcctgggccatgatacgggtcctgtccgagaatgaccgcttttacatcctcatagggcgtataatgcaaggcgttaaaaatatcatggctgtcaggataaatcgtttggctgctgtattcttgtttcagcatctctctcagctcttgataatacggtttgtcaaattcatctttcagctgattccaccagctgtcttttaaaagctgtttcaaactgtccgtcccccttatgaactgtgcagtcttgaatggacgggctttccgtcccacacaatgtcagtcggcgcctcccgcctcttcatgtccggctcttctagaagaaccgcgaagtttttcgtcgggagctccccaagcccgtgcttttcgcttaaccggtctaagtaccgcttccgtttgccgccgagatccgcggactgattgccgcctccctcaaaaaacgcatatatgacgctcgcgcaaggcacacgcttcacacggtgctgtttcgcggcgcgcaaataaaagtcccagtcccaataattatggacatccggatcaaaataccctaacgtgtcatgcagagaacgtctgtacatgctgcctgacggaacgtacgtggaaaatacccgcatatccgcataatccgccgtataggcgaacggctttcgtgacaccgggtatctcgtgccgccccgttcttcaaatgacacaatttccgcgtcagaatggacaaaatccgcatcagcaagtgcagccgtcattctttccaaatggcccggcgtaatgaaatcatcatcatcgcacagcatgatataatcaccccacgcttttttcacacctgcgttccgcgcttccacatgtccggcattctgttctaaatcaataatctgaatcggcagatcgctgtacagctgcttcgcttgttcgaccgattccccggcatcatttacgatgatcacttcataaggctttatggtctgcctggaaatcgactccagcagctcacacaaagccggaatccgattatacgtgactatgacaattgatatattcatgacccgctccttctgctttttctcatgttctattaaaacataaagcggcggagagatcaggggggatttttgatttcggcccattcagaaacaaatccacgtcatccccgccagcaaaaccagaatgatcagaaggtctccccaaacagtgcataccgccttggcattaagtctgcccgcctccatggcattccacagttttgattgataaacaggcaccaacaccatcgcatagcatgtgcacaagcagacaaaagccggcgggacaagcgcacacatccatcctcatgccaatcatgaatcagttccggtatactcaccccgctgtcaatgtacaagtataatatacccgccagcggaatgagcgagctgacctgcagctcgaaaagtttcaccttccactcacgcgcaaacgaaacagcccaaatccatcccagcgcataaaacaatagaagaagcaaaatactgaaaacaacaaaagtagcgtcttgcatcccattcagaaccataataaaaagactcacaacgggcaaggcaagaaccaagccgcagacggtaaatacggtaacggctatttgggcgcacgcgccgtacatccacgaacctaatctcatataaacacccctatatagattccctatgtatatagtgaaaaagatcaggcaagtctctgcctgcctgcgtaaaaacctattttgccgcaaaacggaaaacataccgtcacaacggcgcatactgccgcaaaactcggtgtcaccgccgaaggaaacagcccagccggaaccagattgaacaaaaagacaaacataaaacatagattcggcaccattgaagcccataccgtccgctcagcaagctttttgccgccagccccgaactctttgccagcttgatagccgatttggaaccaatacagcacataaccgatcataatcagccatactgacacggaaatccctttccacagcgcgtcaactgcgggatgaatcctccacgcgtgcatcatcgtaatcatcgcccccatcacaaaaagagcgcagttgcagaacagataaaagagcataaaagtccgcgcgggcaccgccgaagctttttgaaaagcagagataatttcagacggagtccccacttcccgcagaataagctccatcgcttcgctttcggttttgcctttttccagatgaacacaaatggcatgatgaatatggctttcgatttcctttaataattcacggcttccggccttgccttccagcccttttctgatttcgtgcacataaaggtctttatccattctgcccgccccgcttcagcatccggtccatcagagcggagaacagattccattccttcgtccgttcggctagaatgttttttccttcatcggtgatccggtaatattttcggtcgggccctttggtctgcttttcccagtaagaagaaatatagctttggcgttcaagcttatgaagcgatgggtacagcgtgccttccttcatttgcagttcattcccgcttcttttctccatttctttcacaagttcatacccgtacatgggccgttcattcagcagcgtcagcaccagaatgaccgtgcttccctttacaagctccctgttgagcatttattttctcacccttacctagtaatcttatgtaggtattgtacgcacatcccccgcggctgtcaaatcattcctccaagccttccgtattgtgatcgggagaaaatctaactataatgagatataaaacactgatggaggccattgatatgtcaatgcacaaagcacttactattgccggttctgattccagcggcggcgcgggaatccaggccgatttaaaaacatttcaagaaaaaaacgtatacggaatgacggctttgaccgtgatcgtagcgatggacccggagaacagctgggatcatcaagtatttccgattgatgccgatacgattcgcgcacagctggcgacgattgttgacggaatcggcgtagacgccatgaaaacgggaatgctccctaccgtggagatcatcgagcttgcggcgaaaacgattaaagaaaaacagctgaagaatgtcgttattgatcctgtcatggtctgcaaaggagcgaacgaagtgctgtatccggagcatgccgaagcgcttcgcacccaattggcgccgctggcaaccgtcatcacgccaaacctgtttgaagcaagccagctgagcggtatggatgaattaaaaacggtggaagacatgaaagaagcggccaagaaaattcacgaactcggcgcgaaatatgtattgattacaggcggcggcaaattgaaacatgaaaaagcgatcgacgtgctgtatgacggagaaactgcggaagtattagaaagcgaaatgattgatacaccttacacgcacggagccggatgcacattctccgccgccgtgacggcagaactggccaaaggcgctgaagtgaaggaagccatctatgcggcaaaagaatttatcactgcggcaatcaaagaatccttcccgctgaaccaatacatcggaccgactaaacattcggcgatgcgtcttagcggaaaataaaataaatatccccctcatgatcgagggggattatttcatttttttcgcggatgaccgcaaaaacatctcaatcgattgcacaaacagcgcatattccttcatctgttcatatgtatgcctcagccgatcactccattcattgtgcggctcagccctcttgagcatgcgattcagctgaagcaatacttctttatattcttcccgtttatcttccacttgctctgcggctttgacaagtaaacatttcggcgtcatcttctgatttttcaaaactgagaaaacaactccttttattcctggaatcataggctttcgtttgaagaatagcacagatggcataggtttcacataagaaaaaagaacgattttctacaaaagtgtccaaattgaggcatttatttccgttttcccaaccgaagtgacggttacgtcatcatttcccgggaaaggaaaatatctggcgctgaatacctcttctccatcattcaaaaataattcgatggaggatgcatccagaaagagctggacggaatgcagctcgctgatggcgcagcttctcttttctttttcttctccgctgaaagcggtgcgctccagcacagccagcccctcttcctgatgaaatataaaccgggccgcgccccgaattgagatttcaaaaccggattcgcaagtaatgtcttccagcagcacttcagcccgggacgcatctttcaccgggaggcttacagacgagcaattcaattgaagacggcgcttttgttcatccgtgcggcgcgatttcatttccgggagcgggcgctgtatgattctgccgttggacagtgacagctgtctcggcatcgttaagcagtgaatccagtgatacgcatgtgtcggatgtttgtcctcatgctgatccggaacgcccatccacgcgaacagaatcctccgtcccttatcatcttccagcgtctgcgccgcataaaaatcaaatcctctgtcaagctccgtaaattcaccgtgcttaaattctggcggctctgtatgcagcctgccgaggaaatagcccgcctggtggctgttatgatattttatcccgtcggcttcaagcccctgcggacatacgagcagcacgtcggttccgtcaagggaaaacaggtcgggacattcccacatatagccgaatgacccgagaccgcccgagtccgcccccgcaatcgaaccgagaaacgtccaatccgtcaggttctctgatgtgaacaatacagcgcttccggtgagcttttctgtctgcgcgccgagcaccatgtaatacgctccgtctttcttccaaaccttcggatcacggaaatgagcggtatagccttttgggagacgcgcgacgattccttttttttcaaatacgatcccgtcttcggatacggcgaggcattgatacgtttcccgatttccttctccgtcacggacattgcctgtgtacatcaggcagagccgcccgtctttttcgatggcgcttccggaataacagccgtttttgtcataccactcacccggcgcaagcgcgatttcttcctctttccactcaacgaaatctttcgtcgtcacatgcgcccaaaatttcgcgccgtgccccgtatgaaatggctgccattgaaaaaacaagtgatatacgccgttccattggatgacgccgttcggatcatttaaaagcccgaccggcggcataacatgatagttctggcggtatggatctgacgcggctgtttcttgccgcttctttttcgcttcctcagcctgcaggcgcagctcttgatccggtgtcctcatttgacggcctccttttctttagctcccataatgtaagcggcaataaacgccgagacagaggcgatgcccattccgatcagatagtttataagatttcctaaaccgagcggagccgtgatggcaatcatcggaattccggtcagaccgtaagcattggcggcgacgccggtcaccacgacataggcccctcccagcgctccgccgatcattcccgcgataaacggcttccggtaccttaggttcacaccgaaaataactggttcggttacgccgagaaaagcggaaaatgcggcaggcagagcgatttctttcattttcgcttttttcgtcaggaaaaatacagccagtcccgccgcgccctgagcgacattcgccatcgaccagataggaaggatatagtttctgcccaaatcagcgatgaggccggcctcaatcgcatgaaagctgtgatgcacaccggtgagcacaataagcggataaagaccgccgaaaagcagtccggcaacaatgcccgcgtgatcatacacatatgtcagcgagacggtaatgcctgatccgatcgccctgccaagcggaccgattgcgataaaggtaataaatcctgtgacgatcaccgtgacaaacggcgtgaccaataagtcgaatgcgtgaggcaccatttttctcgtgcccttttccactttgctcataatgtaaacggctaacagtacggggatgaccgtcccttgatagccgagcagcgcaatgtcgaagccgaagagctgcataaaatcaggcgatgcatccgcaagcccccacggattcaaaagcgccggatggatcataatccccccgagcacggcaccgagataggcattgccgccaaattccttcgccgcactgaacccgatgaatacgggcaggaagataaacgccgcgcttgaaaacatgtctaaaagcttaaacagcgatgattgttcagacacccagtggaaagccttcatcataccgagcagccccattaaaagtccgcttgccacgatagccggaatgatgggaacgaatatgttagacagtgttttcgcaaatcttgcggccggattcagcttttttttcgccgcgtcctgatgtgtctcacgatcctcccgccccaaatcggcttcttttgaaaaagcgtcatacactttattcacaaggccggtaccgaatataatctgatattgccccgagctgctgaaagccccttttactccttctgtctcttcaatatcggcctggctgatcttctgttcatcttgaatgacgagcctgagccgtgtggcgcaatgtgtcgcgctgatgatatttgatttccctccgatatgtttgataagctgttttgccgtttcttgataattcatgatgtatccccctttctaaaatcaaaaaagacctaaaattcgccaacgaaaaaggtcagcatgatccctttttcatgtacgcaaattttaggtcttgcctgcattaccagtcacaatcccgccgattcagttttttaatgcgctttcattttatttcatgatagcgctttcgtcaatatgttttcaaaaaaaaagtctgtttctcgaaacagacgcgttattccgggtttttttgcagacgctggacatgcagcgtaatatagccggcctcggattccggcagttccaaatcatattcattttttaaaaacgccgccagttcaagcgcacaccgataagcaaacggatactttttttggatgaaataaagcatctcctcgtccatggaatggagtgcttcatttgagtccaaccggctgaccgcataccgtaagtgcgtgacgaggcgctgataggaaatactgtcttcatccaccttctgttcgaaaaaggattcgatcttttcgatcatttctttgatcatggttgtatgcttcatcgccgaatacatgcttttggcatccgccttggcagtgtggatatgaagcgcgatataccccgcctcatcatcaggcaatgatataccgagggtttgtttcacgtgttcaaccgcccagcggccgatttcatattcttttttataaagcgccttaatttcatgaagcaatcggttgtgcacctgaaggccgttttgaatcctttcgatcgcaaaggataaatggtccgccagcgcaatgtggatgtgatcgttcaaaggcgccgcaagctctccctcagcatggctgatgatatcttcagccgcctctatatgctcttcgggaagcgtttctaacacttgtttgaacttttcattttcgtcgtgcacgacaaatattttttcaattttatgtttttgaatcacatcattttttctcttttgaaaagcgattccgggacccattacgatcttttcccgtccgtcttcttttattaacgccgcattgttatttaatactttgtctattctcaagaggttcgctcccgttcatatgtttagtgggattgtaccctctttttcatatgatgtaaaggtgccggacccgcgcgctcccgtttcggcaattctttgcggacaggcatccatcggtttttatccagcctgccgcgggccgatttcgtttcatcggtcaaatccgccgatcggactcggctcacaaacgaaaaagcaccagccgtccgcttcgctttcttatgataagccgcttggtttccgtacacggcggctaatggatatcttccgttacccggcgccatccagttcatcagaaagaccatccacacccgtaaagatactagcaaacgtttcattgcaaatcatccctccgcttctttttgacagacagcttgttcgcaggcctgtttttctctccgctttaacggaaaaggcggccgatccttctccgctaaaaactagcgggtctagcaaccctatgactctatgatagacgcggcagggcgaattgtttgtcacaatatgagtgaaaaaacaaactagttttcagaagttttgttgaaagctgatggaaatgacctgaaaaatggaaaagccgataaaaaagttatacacaccttatcccttggttaagcacagcttaaacacagggtatatccacatatccacaaactcgatctatattttgtataggaacattcgttcccaacaatatatatacacaattttattcagttatgcacaggattttgtgtataactccctccttattcacagaccaatttccataaatgagtcatatgtcacaaggattattttgaattttcaagaaatatatactagatttctaatttagataaagaaaaagggggaaacacgattgaaaaaaggaatcatccgttatctgcttccggcttttgtcttatcctttaccttatccacaagttcacaggctgcgccggcaacaaaaccgcaaactcctgatcttgagaaggctgaggtatttggtgacattgatatgaccaccggcaaacaaacgacagtcatcgtcgagctgaaggaaaagtcactggcggaagcaaaggaactcggcaaagcacagacaaaaagcaagctgaaaagcgaacgctcaaaagtgaaaaagaaagcgctcaaaaccattaaacacggaaaaatcaacagggaatatgagcaagtgttttccggcttctccatgaaactcccggcaaatgaaattccgaaactgctgagtgatcaggatgtcaaagcggtttatccgaacgtcacctatcataccgatcagctgaaagataaagacatcaccctatctaaggatgccgtgtctccgcagatggatgacagcgcgccttatataggggcaaatgacgcgtggaagctcggctatacggggaaaggcgtcaaggtggccattattgacaccggtgtcgaatataaacaccctgacttaaagaaaaatttcggacaatataaaggatacgattttgtggataacgattacgatcctgaagaaacgccgtccggtgatccgagaggcgcgtcgactgaccacggaacccatgtcgcgggcacggtagcggcaaacggaacgattaaaggcgtagcgccggatgctacactccttgcctaccgtgtgctcggtccgggcggaagcggaacaacggagaacgtcatcgccggtattgaacgcgccgtacaggacggagcggatgtcatgaacctttctctcggcaattctgtgaataacccagactgggcgacaagcacggcgcttgactgggcgatgtcagaaggcgtcacggccgttacatcaaacggaaacagcgggccgaacaattggaccgtcggctctccgggaacgtccagagaagctatctccgtcggagcgacacagctgccgctgaacgagtacgccgtctccttcggttcctattcctcagcgaaagtaatggggtacaacaaagaagatgacataaaagcactgaataaaaaagaaacagagctcatagaggcgggtatcggcgagcaaaaggattttgaaggcaaagatctgaaaggaaaagtcgcggtcgtcaaacggggcagcatcgcctttgtggataaagcagacaacgccaaaaaagcgggcgcgatcggtatggttgtgtataacaatgccccgggagaaattgaagccaacgtaccgggcatgtccgtgccgacggttaagctttcatcagaagacggcgaaaaactcgtcagccaattaaaagcgggcggcacaaaagcgacattccatttatccgtggctaaatcgctcactgaacaaatggcagacttttcgtcacgcggtccggttatggacacgtggatgattaaacctgacgtctccgctcccggcgtaaacatcgtcagcaccattccgacccatgatccggccgacccgtacggctacggatcgaagcagggaacgagcatggcttccccgcatgtagccggcgcagctgccgtcatcaagcaggccaaaccgaaatggagcccggaacaaataaaagccgctcttatgaacacggcggaaaccttaacggacgcggacggtgacgtatacccgcataatgcgcaaggcgccggaagcatcagaatcatgaaggcggtcaaagcagactcccttgtcgccccgggaagttattcttacggaacgtttatgaaagacaaaggcaatgaaacgaaaaaagaaacctttacgattgaaaaccaatcgtccatcagaaaatcatatcagctcgagtactctttcaacggcacgggcattaccgtttcgggcacagaccgggtcgtgatccccgctcatcaaaccggaaaggtcaatgcgaaagtaaaggtcaatgccaaaaaagtaaaggcaggcacctatgagggaaccgtcacagtgcgtgaaggcggaaaaacagtcgcaaaagtgccgacgctgctgattgtaaaagaaccggactatccgcgcgtaacgtcaatcgacgtacaggacggcacaacgcagggaacctaccaaattgaaacctatcttccggcgggagccgaagagcttgccttccttgtatatgacagtaatcttgactttgtcggccaagccggcatctacaaaaagcaggataaaggctatcaatatttcgactggaacggcaaagtcaatggtgacaccgcactgccggcaggagaatattatatgctggcctatgccgcgaacaaagggaaatcaagccaggtgctgactgaaaaaccttttatcattgaataaccgaacaaccctgctggagcatcagcagggtttctttctgactattcggcaaaagcttctcgaagcagacggtatgactgaagtttatcttcaaaatgatgagtaatggtcacagccattacttcttccgttccgtatgctttactgagagccagaatctgttccttcacttgctgcttcgttccgatgatcatccgattccgattatcggcaattcgtctttgttcatacggtgtatacgtattgccgcggacggtttcgtaagacggtacgccgtgaagcggaatcccctgttcacccgcaagcagcgtataatccatgacggccgcgagttcctccgctttctcttccgtgtccgcgcacagcacaaacaccgccacggctgtttttggttcttttcctaatacagaaggtttaaatctgcgcttatattgtgctgtcgtgctttctccgccttctccattaataaagtgggcaaacatatagcctgctcccatttctgcgctcagaagcgcgctttcccccgaagaaccgagaagccagacttccggcgccgtcttaataaggggtgatgcggtcagattcggaaaacggtgattgtcatcagctgcatcatgcaaatacatcgccagctcacgaagctgctgcggatattgatcagcgttacgcttcccgccgtcattcagcgcccatgatgcgatcggcattccgcccggcgctctccctaatccgagatcgattctgcccggcgtcaacccttcgagcacgcggaaattctccgccactttatatgcggtgtaatgcggaagcatcacaccgcctgatcctacccgaatgtcattcgttttcgccgcaatatggctgatcagcacttcagggcttgagcccgccaaccgctctgaaaaatgatgctctgacacccaaaacctcttatatccgagcttttccgcctcctgcgccaatcttactgtattccgcagtgcactttccgcagaacacccttctgatacaggagattgatccaatatacttaatgaaatcatcactgtcacctcatcaacatcgtaccactgctaagccgttttttctttctgtatgcttataagcatccctgatgataaacatttatataccttgttccattttgtcgaaatatgttacacgtgaaacataaaaaaacctctcccggtcaggagaggttttttcttaattcttttgaaaacctttatcttttacatattgatttaaataggttctcggtttttgtttcatgaactgcaggatttgatcagaccacgtttcaacccgcttgccgtttgtccgtttatcataataatcggaaatggtttcatcatattccttcatataactgcggaagttttcttcattcgtatcgtacgtgttttcatgatatacggcttgtttcggcaggcgcggcttttgaccggacggatgagcgggatgaccgactaccaagccgaacagcggcagcacatggtcaggtgtaccaagcacttctgtcacctgatcaagttcatttcgaatgcctccgatataacaaatgccgagtcccattgattccgcggcaacacttacgttttgtgcggcaagtgcggcatcaatgatgctgaccataaacatttccgtattctcaagaagctcggtaatgttttctcctttttcctcagcaagttttttatggcggtacaaatcagcgcaaaacacaaacaagtgcccgttattttcgacgtaaggctggtttccggccagtgccgccagcttccgctttttctccttatcggttacgccgatgatggagtaagcctgcacgtaactggacgttgacgccgcctgggcgcttttcactaatgtatctatctcttctgctgtcagaagctcgtcagtaaatgatcggatcgaccgatgattaagtatggtttcgatggtattgttcatatataaagcctccttctctatatatcatatccgaaagagtatcatgccaaaagcgaaatgctctaaacaaaaaaagacagcccgaaaaacgagccgtctcacattaagaattgaacaagtagcttttatatttcgtcagctgcacacttgcgttatatacgatcccgaagctgattaatgtagaaagcaccgagctccccccatagctgacaaacagcagcggaataccggtaaccggcataatgccgatattcatcccgatgttctggaaggtgtgaatcacgataagtgcagtaaatcctacgcaaaaaaacgcaccaaatcggttaaacgcatgcaagcggtcaatcagcaccacaagcctgtaaattaaaaagaaaaacatgacaaccgcaatggcgcagcctaaaaatccaaaactttcacccaaaatcgcaaagataaagtcggtctgtccctcaggtacgtacactttcagattatgaacgccgtttccggtaatgccgcccgatccgatcgccataacggcctgatccacctgccagcttttatcgctctcggcctgagtcgttgccgcactggagtcagacatccacgatgtaatccggttaatttgataatccgcaataccgatcgaattcgccacatggggaaattcaattacaagcactaagaataggccaagcacaagcgcggccgaaccgccgatgatggtgatcagcttccagtttacacctgacataaacaccatcaccataacgataaacagacagatcgcacccgttccggcatcctgcaaaacgatcatcccaattggaataaccgtccatgccgcaattttcaaaagcagattgacatcttcccgaagtgatctttgatctttcgggcccgccttcgatataatggacgcgaccatcatcatgattcctattttcgtaaactcagatggttgaagagtgaagctgccgattttaaaccagctcttcgctccgtttttgatcggtgcgatggattccggcgccacacgcagaaggagcagtgacagcacgccggcaattaatacgtacagactcagtttttcaagctgctctaaatcaaagtacatgatactgaccatgagaccggctccgatgacataaaagacgatctgtctcatccaggcatcacttccgtactgcccgaactgtccggccgcataaatcgccgcaacactaattattaaaaacacaccaaatataaaaatcaaatccccctgataatagggattttgctgtttcttatatcgactcattctatcccgccttacattttcatcggaagtcactattgtttattatacatgaacaccgttcaagaaaacatgatgaggttgcttcctttttattttttatggtttggggactacacgacatatgacgtgtcagaaaaggaaatgtttcggtcatgatgaaacttttccgataaaaaaccccttctcgtcagaaaaggggtttcagtctatgtttaacgtcataaacaagctgttcgggtcctctttataatgtgcaaacggatcacaatattgaaacccggctttttcatacaggcgtctggcggggagaaaagcctccatagaaccggtttctaagctgatccgctgatagccccgccgccttgcttcttcaagcatatggcggaggatccggttggctgcgccttttctgacatgatgcggagccgttttcattgatttgatctcaccgtgccggctgtttagctccattaaggcgccgcagccgagcaggacgccgttttccctcgcactccaaaacgtaacgtcaggctgacgcagccggtccgcattgagcgcgtgtatactttccgggggagaatgcatggtcatgctcttcagatgctcctgcaaaagcgcaatgacgtccggcgctgtgacatcgtcttttgttatgtccacttcaaaaccacccttgctgtgcatgttttctttgaacatagcaaaggttcacagcctgcgccattcccttgtccggaaatgtgacagggtatttgacctttccggtttcttgtacctatccaaaaatgaggcaatagttgcaatacatttctcgaaaaagcggtatcaaaaattggaaaacatggtataataattgtaacaaaatgttcaaaaaacgaccacaaaacagacacattttattctctgtatttcattttggaaacgctcccataaaatgaaaggagacatgtaagatggacatgttttttgcttatttactggtcgcaagcgcaacacccctctttatctggctggataacaaaaaagtcgctctttcggccataccgccaattattctcatgtgggttttcttctacttttacgcaaccagcagcctgtcccctctcggccacacactcatgatcatcctgtttgccgtcaacgtcatcgttgcccatatcgccgcctttatcatttacggccttccgcgcctgcgccggagaagaagccaataaaggcacaaaaaaccctcttcgcctgaacgaagagggtttctttttattcctgatgttcggaatgttgcttcgcaccgccaggagggtttccatccatatggtcaccgtgatggtagtgcgccgcaaagatccagatggaaccaaggatgataacaatcgctccgaaaaatccgaagagcgtgtttccgacttgaatcccgccgttttcgctttctgtcatgtgcatgaacatgagaagctgaagaccggcttggataaatgcgaatccgaaaatgatccacagttttgctgatgggcttaattccgtatataccgcaacccaaagggccagcagggtcagaataatagacaacgcaaaacctacgatatgcttccacggaaagtggctgtgttcagcagatttgtttgccatattatagtccccccaatccgatgagatagacgcctgtaaagatgaagatccaaacaacgtctaagaagtgccagtataaacttgagataaagatttttgaagacgtctgcggcgttaatccgcgtttcttcaattgcagtaagatgccggcaatccagaagataccgatcgttacgtgcgttccgtgcgttcccagaaggacgaagaatccagaccagaaagcacttgtaccgagagatgctccttcatgtacatagtggatgaactcgttaagctcacatccgacgaagcccgcaccgagaagaagcgtaatgatcgtccaaatgacgacgccttttaaacttccgcgacgcatttcatgaacagcgatcccgcaggtgaaactgctgatcagaagcaggaatgtcatgatcatgacaagcttcacttcaaataattcagccggtaagactcctcctgctgttcttctttgaagaacgaagaaggttgcaaatagtgttgagaacaacacaatctctgcccctaaaaagatccaaaacccgagaatattgagtctgccggtttcagattgatattccataggcgcgttagaattgccgtgttctgcatgttccataaatcacgcctcctttattcggaaatctttctttccgtctcttttatttcttcaacaggtatatagtagccattgtcatattcaaatgaacgaagcaccatgcaaagcagaatgccgatcaagccgacaatgcccatccagaaccattcaaacacaagcccgaagcctgcaataccgaacgccactgacataataagcggtcttccggagttgtgcggcatatggattttcttgaacttgctttccggatgaatatccgttttgtcttctttcaattgcaggtacgcatcttgagatttcacttctggaagcaccgcaaagttgtaatgcggcggaatcgcagatgaagtcgcccactcaagcgtacgtcccacgccccatgaatctccgctgatctcgcgagtagagtagcggaagctgtagtagatgttgtagcaaaggattaagaatccgacacccatcatgaaggctccgacagttgaaataaagttcaatgcagtccatccgtcattcggtccgtaagtgtaaatacggcgaggcataccttgcagccccaagaagtattgagggaagaaacatacattaaatccgatcataaagatccagaagaaccattttccgattctttcgttcagcttgtggccgaacattttcggataccagaaaataaatcctgcgaaacatgcaaataccgtacccgcgatcagcacatagtggaagtgagatacgaggaagtacgtattatggtattgataatccgctgcagccatcgcaagcataacccctgttaccccgccgacaacgaagttcgggatgaacgcaagcgcccacagcatcggtgttgtaaaactgatccggcctttatacatcgtaaagagccagttaaagattttaaccccggtcggaaccgaaatcgccatcgttgtaatcgagaagaaagagttaacggacgcactgttccccattgtgaagaagtggtgagtccatacaaggaaactcaggacggaaatggcgataattgagccgaccatcgctttgtaaccgaataactgctttcttgcaaacgctgaaataatttcagagaaaataccgaatgccggtaagataacgatatatacttcagggtgtccccaaatccagaacaagttagcccaaagcatcggcataccgccggcttccagcgtgaaaaagtgggcgccgaacaaacggtcaaatgataacagcgccaatgccactgtcaaaacagggaaggcgaatacgataataaccattgtaatcagcgtcgtccatgtgaacatcggcatacgcatcagcgtcatgccttttgtacgcattttcaggatcgtcaccataaagttgatacccgtcatcagcgtaccgataccggcaatctgaagaccgagcaggtagaagttctcaccaggcccgggactcatgtcgttgcttgccagcggcatgtaactcgtccatcctgcgttcggagaacctccgataacgaaagaaatattgaaaagcatcgcacctacgaagaacgtccagaaactcaggttgttcaagtaagggaatgctacgtcgcgcgcaccgatctgcaaaggtacgacaacgttgatcagaccgattaaaaacggcatcgccatgaagataatcatgatcgtaccgtgagtcgtaaagatctcattatagtggtttgagtctaaaaaactgttattaggaagcgctaactgggcgcgcatcatcaagccgtcgaccccgccgcggaacagcatgataacagcagagataatgtacatgattccaagtttcttatggtctacagacgtcagccattcagaccagagccatttccactttttgaagtatgtgagtacaacgatgatagcgatagtggaaagcgcaatggaaacttgtgcgcccagaattaatgggtcacctgttacaaaaaattcatcccatctcaatttcattcgggcttcctcctttcttgttcaatttcaatcttgtttatcgtcggatactttaaattcgtttttctttacatcttcccacgggtctgttttagagtgcggtgatacggctttgtagccaaggcgtttgcgcgcctccatcgcatattcggcatcttggccgtggtcaacgtattttaagtgtgtagaagagaacgttaattttccgacattctccggaagcatcagttcgtcatacttctctttcgtcagctttggagaatcgctttgggcttttttcacccagctgttaaagtctttttgcgtaacagcttttacgttgaatttctggtcggcaaagtgttcaccggtgaagttcgcgttgcggccttcatatgttcccactttgtcagcctgtaagtattgatccatcagcattcccgccatcgcgtatttttgtcccccaagctgaggaatccatagcgatgccattgaatctgctgaagaaattttaaataaaaccggacggtctacaggaatgttcaggtagttaaccgtctcaatatcctgctcagggtagctgaatacccatttccagtctaccgaagtagcataaacaacaagaggctctttatcctttgtcgcttcaggcgctttttctaacgaatatatcgtctgtacggtaggcacagaaagtgcaataacaattaaaattgggatcactgtccagactacttctaagaacgtgttgccgtgcatctcgggcttgtaatttccgctgtctttgcctttgcggtcgcggtatttcactaaaatgattgtaaatagtacgaatacgacgccgacaatgaacagcataaatccgattgacaagagaatcagatctttctgctggtctgctacaggtcctttcggatctaaaacggaaatgtcgctgcatccgcccagtacgaaaacaacagccaacatcgctaataaaagtaacggtttaaatgctctgaacaagaagatcaccatccttcctattgatgtagtgaatctgaaatgtactttctcaaaatcttttctctatctaccttgttatgctatcaaaatctgcccttattagctttatttttttctaaagttcatctttttttcgacctaatgtcacaaaatcgtcaaaaaatgcatgaactttttccacttgcgtaaatcaaacataaaaagttttagatcatttagcatatatagagaaaaaagatagcgagaacgaataataccaaataaaggtttaccataataaaaatcgctggtcaacaaaaagtttcattttgttaaacattctacaaaagaattattttttcctttgctcacaccttttcacacggtttccattttaacgcaacgcattgtgaaaaaaaagaccggaacgcgccttgatatgttcattataaaaaacgcattcatatgtttaatatggacaaaacgaaggaaacatataggcataaataataaaaaataggaagtgatatttatgggttttatcgtatctctgattgtcgctattattatcggctggatcggaagtttatttgtaaaaggcagtatgcccgggggaatcatcgggtcaatgatcgccggtctgatcggcgcatggatcgggcacggactgctcggcacatgggggcctcaccttgccggctttgccatcattccggcaatcatcggagctgcgatcgtggtattcttattcagcctgatcgccagaagcagaggataaaaaaaagcctcgtcccttatgggatggggcttttttccggtagagcgcccaaatggcggataaaccgccggaaagccgctctgccttcttctgtctgtttaaagacgccggcatgctccagtatccgcgcaaaggcatggccgatttcctctttcagaatctgttccgcgttttctttcgttaccttccgcttatgcagcacactgagcgcccaatctttatgctttgccgcagaagggtctgccgttaagaccgcctccgggtccggtgagcacagcgcttcagccgtgtatttcatttcttgttcaaggcggcccggcagaatcgcaagccccattacctcaatcagtccgatattttcttttttcaggtgatgaacttcctgatggggatgaaaaattcccagcggatgctcatcagaggtgcggttatttctgaggacgagatctaattcgaataaaccgtttctccgccgggcaatcggcgtaattgtattgtgcggtgtttctcctgaacaggcgaggagatcagccgcctcatcggaataaccgcgccatgcccgcaggatggcatccgccgcgccggaaagctcagacgcgcactcactctgcaggcggatgaccgacatcggccacttcacaattcccagcaccgttttcggatagtcaggcagcctgtaccagctttctgtctccgccagcgccatcgggaattcataatggcccccctgaaaatggtcgtggcttaaaatactgccgccgacgatcggcagatcagcattggaaccgagaaaataatgaggatactggctgacgaacgacagcagccggtcaaacgtttttttgctgatcttcatcggttcgtgccggtctttcaaaacgatgcaatgctcccggtaatacacatacggagaaaattgcagaaaccactgctcatcgccgagaatgaccggaatgacacgaaggttttgacgcgccgggtgatccggtctcccctcgtacccgacattttctttacaaagaacacatcccggataatcggattgaggctgctctttggcagcggcaattgctttcggatctttttccggttttgaaaggttgatcgtgatgtccagctttccgtaagccgtctcagccgtccatccgacattccgctgtattctgtccgaacggatataatacacatcctctgaaaatcggtaaaacgcctttgtcgcctgctccggcccgtgcaccgcctttgtttcttcaaaacgacgcacaatctcggacggctgcggggcaaagcagcccatgatcttcgcgctcagcaggtcgcgataggtgtctgtatcggctgcaatccggcccgtttctgccgcccattcataaatcggggccaatatgtccggcaatgatgccgccgattcattttctttctgttctgaagcctccggatgggtaatatgcaaagtttcatataaacggtttcttgtatattcaatatcaagaaatgaaatcagctctttttgcaatccgtactggattaaacgttccacgtgccgctcaattgccatcgtcatccccctttagttctctcgctccggcgccgatatccgccgtgtaaaagtcagcttttctctctgtcttctcctcatagcggcccccgttagctctccgatgagattcactctgccgggcgcaaagaaaaagcgcaggtctcggattccccgaatacatcagcaaacgctttctttattttgcgcttcaaacgcatccccttccaccattacactttccccccgggacgcggaaagaaacggttatgacacgccctcttctttcgcttttctgaagacaatccacttgctggccgcatagttgacgactacaataatgacgttatcggcgattttcgccaatgtttcgttcatatgaaattgactgaccagaagaatcatcatggcgagatcgatggcgagagacagtacccgcacgctgaaaaaggccgttaattctttcatcagactccgcatccccgcggtcttttgctgaaagacataccgtttattcgtaacataagcaaatagaacggacagaatccaagcggcgacagtcgccgccttgtaatccatctcaaatgccgacgtcagaatgtaaaaactgacgatattcacgatggtcgtgaatatccccataatgatatacatcataatttctctgtagcgcatggcagttcctcgctttctgaaagacttttctaaaccttttgtcaaatcaagaagaacgttaccctgattttctggtgctgacaaaaacatagagcgcgtcaaacatgctgcggaaagtaaccggccttcccagcacattggattgcttaatcaccccgtcgatgagcgcgcacatcatgttagcggtatgctcggtatctatatggtcttctattaaatttctcgatttgagccaatttatgtacatggtgctttcttctatccataacttatacaggcggatataagcttcatattcactgacgactttgtaagtaggcatatgaacggcaaaagacacaacattccaggcaggcttgctgtttacaaaccgcatcaacaggctggccgcgctggccgcggcttcacaaagcgtcaacggccgctctgtttgcttttctaattcgtcgagatagccagtgatgatcctttttttaatctgacgcctctctaacaaatgcttcagaaaatcttccttgctttcaaaatgaacgtaaaacgcccctttgctgaaacccgccgctttactgatgtcatcgattgagactgaatcgtaagctctttcaatcaggagatgaaggcctgcgtcaataaaactttcaaatgtttcttctctcttaatttgaaatttgttttttttcattttttaccccagctgtttgatcattcactttatcttacaccgaatcattcttttgcggtattttttatgcaaaaagaatatgctaatcgacgttttgagggtaaatgttaataggtcatatggtttatttttatttgcatactatccagtcagtatttatttgtttattattatatgtaagaattcttgaaggattttggttatttcagtcattttcttagggaataggtaggtgaattcatcttcaatttgggattaccggccaactatgtgtgatatttgttatacattggctgctgtagctgggcaaatcaatttttcaattggaggttcttatgaaaactcatgtaatgaaagatatagatcaagattggcaattgttaattcaagaggctagaatcatgggtttgcacattgacgatgtgaggcgcttcttaaatactgaaaaagcggtgaagaaaaaaacaccaatgaaaaacaccatccgccagcggtaagattacaggcggatccttttactatatgacctgccacagtccgcccgcacccgagttttcaaaggaacacccgcaataagaggggaatcagagaacaaaccgtataccggacaaccattcccgtccgcattccgcaattgaacagccaaacatggtgatatgagatccccccgctgcatatcttgtgtattatgcccatttatgaggtgatacacagatggatacgaatccctattatgatgaaaaacaacagaactactacgaaggcctgaatccttatttattgaacaaaatagacgaaaactggcggacagtgcttgatgtcggctgcggcacgggcaatttaggagcggcgatcgaagaccgcggaataacggtttacggcattgaagcgtatcccgaagccgcaaaaaaggcggaaagcaaattgagccacgtgctttgcggcgacattgaatccgccattcttccgtacgaatcagagcaattcgactgcatgctgttcggagacgttcttgagcatcttgtcgacccgtggacagtgctgaaaaagcttcgtccttatgtaaaaaaagacggcactgtgcttgcatgcataccgaatgtcggccacatctcagtcgtgttggagcttttagccggcaaatggacttacagtgacgccggattaatggatcagacccacctgcgtttttttacccgggaagagactctttcattatttaaagccgccagctatgaggtcaaacgcattgaggcgatccgcgttgatcacccttcttaccacaaagccatcgcatcattgcacgaagtatgcgtacagcttggcataaggcatgactttatgacagaagcatcggcctatcaatatgtgattgaggccgagaggagcatgtaatggattcacattcatttctgtttgtcgtctgtgtgaatgatgagtcgctgtactcccggtgcaagagccatatcatgcagcttaccgtccccccttcatactccgttgatatcatgccgatatacgattcagcaagcatggcctcgtcctacaacaaagcgctgaaacacccctccaaatataaaatttatctgcatcaggatacttttatcattcatcagcatttccttcatgacatgcttcatatctttcaatctcatcaggagctcggccttctcggtgtcgccggctgcaaaaccctgccgccgaacggcatttggtgggaaagcggacagcggatgggaaaagtgattgaataccgggggaatgcttatcacccgctggattttgagcacggtgatgaagacggcctgtttacgcccgctgacgccattgacggcttgttaatggcggctcaatatgacgtggagtggcgggaggatttgtttcgcggctttcatttttacgacacatcacagtcgctcgaatttcaaaaacacggctatcaagtcggcgtcgcctgccagaaagacccttggtgccttcatttttgcggcgactcctttgacgccgcggcatatgaagcggacagacaaacatttgtcaaacactatatggcaaagccctctcgctgatcgagagggcttttttcgggttaacgtttattcagttcccgctcaatgatttgttcaaaggtttcctttcccgccgcgccagggattctctcatcgccgatgataaacgtcggcactgccgtaatgccggcttcctcataagcatggcggagcgcttcccgctgtacgtccttgtacgctcttgtctcaagcgcctctttgaaggcagcgccgtcaagtccggcttcttccgcaagctttgtcagcacgccaacgtcaccgatattttgttcttcctgaaagaacgcctgaaaaacgcgtgtatggtattcgcttcctttcccgtgttcctttgcgaaatgaaagccttcaaatgccaaatccgtgtatggatgcggtgacacgcgggggaacgtgatttcaacgcctaacgactgcgccatcggctcaatggagtttttccacatctgccgcttggcgggatcattcaccggatcaagtttcggcgaggggctcggacgcaattcaaacggcatccattccacctgtacgtccttgtccttgattgcttcttcaaacgccgctttgccgacatagcaaaacggacatacataatcagaatatactttaatctgcagtgtcattgtaagtctcctttccttatcattttaagttgtaacttttatagttacaagtgttttttttaaaaaaaacaccctccatatggaaggtgtcacgattccagcagcctttgggcgatatattctccttttttacagccgccgggacaggcgaataaggaagagccgatcgtttgtgtgtattcattcagcgcatcctttgccgccaaagccttcagcatcgggacaaattggcggtccgggtctttttgaaagcagataaacaacaggcctgcgtcaacatagcccgtcttcggatcaattccgtccgtataggaaaatgcccggcgcagaatctgtctgccggttgattttgccacgctgacatgcgagtcggcgggaatttgattcagcttcacgggatcggtttcctttttttgtccgaaaggcgcgcccgagcttttcacccgcccgaacgtgtcctcttgttccttcaaggatgaacggtcccatatatctaaaaacatcttaattttcctaaacgccatgtacgtgccgcccgtcatccagtccggctctcctgattgaacccaaacgatcgaattcatcaggttttcatccttcgtgctttggttgccggtgccgtctttgaatccgaagaggttgcgcggtgtttctccgttttttccgccgcttaagaaacctttattgagaaagcggacttcacacacacccgatgcctgtttcatcaggttgcgcaccgcgtgaaacgccgtttgttcattatccgcgcagacctgtatgacgatatcaccgccgccttgtttcttatcgagcttgtcgttaggcatcggcggaatatcggcgaggtgcttcggttttttatctttcagtccgaagcggtccttcccgtctttctcgaaaaacccggggccgaagccgaaggtaacggtcaaattcgccggtgccagatcctgcgactccccggtatcctgcggaggcatatatttatttttctgttcgcctgacgggacggcgcctgaagtcagcagctgcgtcaagcttgtccattgtttgaaaagggagatgacatcggctttgtcgcttgacatgacatcaagcgccgcaaaatacacatacgtctgatgcgccgttgtgattcctgcttggtgctttccgtaaaaaggaacgatttgatcacgatcacgtttttcatcattcttctttgaagcggtggccgccggtttgaagagcggcgcgagtcctccgaggccgctcgctccgacagcgacggctgcgcccgcgacggcgccccacttcaggacatcccgtctgtggatctgtttttccttgttatgttcatcgctcatgctgtgtcttaactccttttaaagcacatcggcaatcttcgacatggtttcagaaagggccgtcagcttcgtgcttatctctctgatttgatctgtacttaatgtatcacaagacgtatacattgatcgcacgttttgtatttcgacatcaaaacttcaaattcgctgaattccgcattaagtttttccgtgacctcgaaatggtctctcacttcgcgctattcactgttttatagagggcttttgagcctgcgctgattggttcaggcgtcactttgagagaagcgatagagccgtcaaacgcttcggtcgatattgcaagcttgattgctctgttcttgacatacggcttctattctcccagtccgtcacgcctttttgcgcacacagaaaaagggccgccctatcgggacagccctgctttggagcgccgaatttcctctgaaaacttccgcgccgccgcttttggatcttcggcttggctgatggcactgatcatgctgacgccgtctgcacccgcttcaatgacgggcgccgcgttgtcagccgtaatgccgccgattcctacaatcggaatggtgatgccctgacgccgtacctcttcaatcaatgtaactccctgcacggcttcagcatctttttttgtttcggtcggatagaccgggcccattccgacgtaatcggctccggcttcttccgcccgcttcacctcggagacgttatgtgctgacacaccgagaatcatatcgccgattgccgctctcgtttcttcggcgtctgcgtcatcctgtccgatatgcactccgtccgcctcaaggcgcaaggccaattcggcatcatcattaatgatgaaaggaatcccggcctgcctgcagacatcctgcacccgcttcgcgaacaggacacgttcatcccctgttaaagaaccgctccccttttcccgaaattgaaaaagcgtagcgccgccctcaattgcttttttcaccacggaaaccgggtctgcgcttgtattgtttgatcccataataaaataaaccgataacatattcttcatcatttcccgagaaatacgcgtcatttttctatcaccctttcaattgcggcaagctcagccgcttcttgttctgagatgcttgccagcttgtttaaaagctcaatctggaagctgcccggccccttatgggaggtgtccaaagcggcaagctgagcggcgcttccgtatacagaaacggctgaaacggccgcttgcagaacgtcctgccccgctgcgcagaaggctccgattacagacgtcagcaggcatcccgcccccgtcaccttcgtcagcagtttatcaccgttttgtacggcgtatgtgtcggtgccgtcggagatgacgtcggtttttccggtaatcgcaatgaccgtcttcagcccgcttgcagccgtcttagcgagctgaaccacatctcctccggcttcccccgcatccacgccttttatcttccaatcaggggcgccggcaatattggcaatttccgcggcatttccgcgaataacggacaagcggacctcctgtatgatcttgcgggctgatgccgtccgaaacggcgtggcgccggcgcctaccggatcaaaaatgaccggaacaccgttttcattggccgattttccggctgcgatcatagcttcaaccgatgccgagctgagggtgcctatgttcaggacgagcgctccggcgattttcgccatgtcggcggcctcctcaattgcataagccataacgggcgatgcgccgagcgcgagcagtccgttagcggtgaagttcgtgacgacattattggtgatactgtgaacgagcgggttttgatcccgcactttactcaagtgttgagctgcggtttgtgcgtccatgcttaatcatccttttttctctttttcggattccataaatacgatttcgtatgctccagccaggctctggcggcaaaggacatatagcggtccttccgccaaatgatggctaaatgccacggaatgaccggatgaacgagcggaatggttctgactttgtcaggatcaagaccgcgacagattctttccggcagcaggccgataccgagattggcggataccatttcgctgataaagtcccactgtgatgtttcataaatgacatgcggcctgaatccggctttcacgcattccgtcataattcgattatgaaggacaaaatcctccctgaaaaatatgaacggctcttctttcaattcatgaagactgcattctttctcgtcagcgagccgatgtgacggatggacgacaagcataagggtttccttgacgattgtgaaggtatgaaaaatctcttcattcgcgggaagcacgacgaccccgatatcaagcgagccgtcctccaccccttgctgcactttaatagagccgtcctcaacaagctgaaacgtcacatcggggtatgtgacgcggaagtcaccgagcactctcgggaaaaagccggacccgatcatcggcggaagaccgatgcggacgtgccctttcttcacttccataatatcgttcagctctgacgtcaggttttggaatgactttgtgatttcctgcgcctgcacatacatgctctgtccggcgtcagtcagttcaacttgccggccattgcggtaaaacagtttaatgccgagctccgtctccaggtttttaatcatttttgagattgtcggctgtgaaacatacagagactgtgaagccttcgtaaagcttttcaaacgggccacttccaagaaatacgttaagtgccggatatccattacatttcatcctttctatagacaaaaggaatacacattattctttatatgtattttacctatagcaaaaccttctgtacaatataaatataagggaggcatcattatgaaaaaattgctgcttaccgttattcaaatcgctctgctgtttatatttgcgcgtctgatcaattggatcacggcggctcttcatataaatattcccggcagtataatcgggattgtgattcttttcacattattgcatttcaagattatcaaacttgaatggattgagcttggcgcagcatggctcctcggtgagctgctgctgtttttcatcccgtctgccgtcggagtgattgaatacggagatattatgtctaaattcggcgtaagcattttacttgtcgtcgtcatcagcacatttgtcgtgatggtttcaacaggtacgcttacacagctgatagcaaaaagaaaggagaaaaaacaaacgtgttcatcggaatcataagtttattcttaactgtcttagtatatttgggcgcgaaaaaactctacattcgttttccgcgggtgtatacgtcgccgcttctgattacgcccgctgttttggtcgtactgctgcttcttgtcaatgtcccgtatcagacatacaatctcggcggcggactgctgaccgatatgcttcagccggcaacagtggcgttcgccatcccgctttataaatatttcccgattttaaagaaatacgccgtggaaattattttgaacgtagcggtcggttcatgtatcgccattctgtcaacagcctttatcgcaaaatggttcaatctcggcagcagcttagtcgacagtctcgtgccgcgatccgtgacgacgccgattgccatgaacgtttcagaaatgatcggcgggatgccggccgttacagcggttttcgtcattttaacggctttattgggaacgatcatcgggccgatggtcatccgctatttccgcattgataacgaaattgcccggggcgtgctgctcggaactagcgcgcacggagcgggaacatctaaagcatttgagctcagctccgtatcaggaacgatctcaagcgtgtccatgattctcgccgcgattatgacactgtgcgcggccccgattttgctttcgtttatgtcataaaagactgctccttacagagcggtctttttttagttgccatgaagaattgatttgtctgtccttcataaaaagacgaaaacacgatatgataagacatgaagtgaaaagactgaagaacggatgtgtcatatgaacggccagcagcgaagcagcatcagaaaaggacttgaagtcgatatcgtcctgaaagccgatcagcgttcaggaaagctgacaagaggaatcgtgaaggatattttgacgaactcaagcttccacccgcgcggcattaaggtccgccttgaagacgggcgaatcggccgggtgcagcacattattgaatagaaaaaagccggagcttcacgcccggcttttttttctttaatttcagcaatgaaatcctcatatgttctccctttatatacaaaaaatttttaaccaactattgactcttacgttgcgtaatactttagagtagccattaaggaggcggcaaacgtaatgggtatgaaagtaaaagaagtagctgacctgattggagtaagcatacgcactctccatcattacgatcaaattggattattgactcctcaggaaacgaccgattccggttatcggctttattctgaagagaatcttgaacagctgcagcagatactatttttcaaggagctcgatttctccttaaaagagattaaagaaatcattactaatccttcatttaaccgaagggaagcattcattttacaaaagaaaatgttgattgagaaacggaatagagtcaataagatgattgaaaccatcgataaatcaatcaaacatatgatgggagagatttgcatgacgaacaaagagcggtttgagggaattaactttaatgataatctttatgagcaagaagcccgcaaacggtggggtgatcaacctgtcgataaggtaaatattagattgaaaaacatgactgatggtgagcaaaaagatttatctgataagtggactgcaatgttcaataaatttgcactccttattaaccaatctcccgagtccccagacgtacaaacagctatcaaagagtggtttgattttctcaatgaaaattttggtgaatattcttttgatgccttttacggattaggtcaactctatattgaagatgaacgcttcactaagaacatcgaccggtatggtgaagggttggcgaagctcatgagtgatgccattacaatttatatagatactcaaaaaaagggtggtgcccattaaaatcattatcgaggatacaattgggcggagggattagtgaggccactttacttggcacagatgagatactaaataatagcgggttttttctttaaacagtaagatatgaagattatttatcccgtattaaagcgatggaagagggttttcttttccccctctttccacgctataaatgatcatcctattttttccgcaagaaaacaaccttcaaatagttcccttctttaaacgccggaatcgttttgaaatcttccggaagcgtgtattcttccaaaatgtcgtaacgctcatttgtttctttaaaggcggtctctataaaacctttaaatttcttcatattgaaggcgctgctgtttgtcgaagcgacgatgatgccgttttttgcggtgatggcgatcgtttccttcagcaggtttttataatctttcgccgcgctgaacgtccgtttttttgtgcgggcgaaagaaggcggatcaaggatgatgaggtcaaacgccagcccttttttctccgcatagccgaagtatttgaaaacatccatgaccttaatgtcatgcgcctcataatcaattccgttggcgctgaactgttcaatcgtttttgcgagactgcggttggcgacatcgacgcttgtcgttttctcagctccgccaagcgccgccgcaacggaaaatgcccccgtataagagaacgtattcagcacccgtctgccgtttgcatacttgtcccgaatcgctttgcgtacatgacgctggtctaagaaaatgcccgtcatcgccccatcgtttaaatccgccgcgtaccgtatgccgttttcttgaacaatgaccggaaaatctcctctttcgcctttgacaaaatcgtcgtcttccacgtattgcccggcagtatcgaatcgtttcttttcatagatcgctttataagaaagctccagtccgtcaatcgcctcaatcatgctgtccttataagcgtaaatgcctttactgtaccattgaatcagcagataaccgtcataaaagtcaatcgtgacgccgccgatgccgtcgccctcaccgttgaaaagccggaacgccgtcgtatcgggcgcgttaaacagatgggctcttgcttcagccgcttttttcagcttgtccagaaagaaacgtccgtcgatccgttcatctctcgcgcgggacagcacccagccgactcctttattctgcaaaccgtaatagccttttccgataaactcacccttctcggatgtcacatcaaaaagatcgccctctgttaaatgagccgagcttccggacagagcgtctttttcaatcagggggaatccttttttcagctttccggcaaatgtatctttcactgtaagtagcttcattgtgcattcctctttcgttttgctttctcttatcgtaccataaaacatgatcaacaccgcattgtcccgaaaaattcaaaacagggggaaaaccatgacagccaaaagaatcgaccatacaggcattatggtcaaagatattgaaacatccatcgccttttaccaagacgttctcggtatgcagttaaaggatcgtatcactcatacgaacggcattattgaacttgcctttctcggctttcaagaagggccggagacagaaattgagctgatccagggctacagcagcgagcttcccgcagaaggaaaagtgcaccatgtcgctttattgactgaagatatcgcagcggagttcacgcatgcgaagcgtcagggcgccgtattcattgatgaagaaatcacgacgcttccgaacggataccgctacttttacattgaaggacctgacggcgaatggatcgaatttttccagcgttaaaaaaacgggcgaaagcgcccgttttttttatgtttcttctgtgacgttttgttccgccgcccgttcctctctccatttttgaagatcccaaattcggaaaaacggataataaatgataaatgtaatcaggagattgatcagctgcatgaccgaaccggagattttcccgcccgtcgccaaataaccggaaatcagcggcggcatcgtccacggcacggcgattcccgccggttttgccaccatccccgtgctcatcccgatgtacgtcgccgtaatggtcaagagcggcgcgatgataaagggcacgattaacagcggattcatgacgagcggcatcccgaaaataatcggttcgttaatgttaaaaatcgcgggcccgatgccgagacggccgagctgtttcatctgtttgcttctggagcgcacaagcatggtcagcacaagggcaagcgtcgctccgcttccgccgacattaatccatatttgaaagaactgtgtcgtaaaaatgctcggcagcgcttctcccgcctgaaaagccaaacggttggcgtccatcgccccgtaccagatcggcgacatgacgccgccgattatggacgcgccgtgtatgccgcacgaccaaagcagcatttgcacgaattcggcgataagacttccgccgagactcccgcccaaaatagacagcggggtgcccagcagatcgcctacgacattgtggagacttttaaaaggagttatttcaataaacagacgggccagccatacaagcgtaataataatgaaaccggggatgagcgcaacgaacgatttgctgaccgcaggcggcactccgtcaggcatcttaatgacgatatttctttgtataataaaccggtacacttccgtagacagcattgcaatgatcatcgcgacaaacagacctttgcttccgagcagcgaaatcggtatgccgcctcccaccataatctctgttgacgagccgtcagggataaacggaatctgatacggcgtcgccaataaaaaggcggcaagggcaatggctcccgacgacagggcatccacctcatagctttccgcaagccggtaagcaatcccaaaggcggcgacaagcgccataatgtcaaaggacgcattcacgggatacccgagtttttcaacccaattttcaccgaaaagaccagccataaaatcggcataaccgggaatcggaagactcgtcagaatcagaaaaaccgatccgatgatgataagcggcatagtcaaaataatgccgtcccgcaaagctcttaagtgcctttggccggcgacttttccggcgacaggcatgattttttcttccatgacccgattgaacgtactcatttatcaaaaaccccctttttgagttcattgcgcagatgtcttaaagcattttctccatcatattttggaaacgcttacatttgcatacagaaattttccttatccctcaggaaaaaaagaattccgcactgccgatatataaagaaaaagggggaattgcaatgtatcacaccctgaaaccgataatggccgcggccttgtgcatcagcctgttctccgccgcggcgcccgcgcacgccgagacgcatgaccgggacgttatcgtggtgtacaaaaatcaaaacggcaaggaatccgccatagacagcggagcggatgtggaacagacctatcagcatcttccggcagtcgccgtgtcagccgattcgcaaacggtgaaagacctgaaacaggaccctgacatcttatatgtagaagagaatgtatcctttcaggcagcaggcggttctgatatccgcccgttatcagcggcccaaagcagcagttacgtgctgccgcaatgggatatcgaaccgactcaggttaagcaggcgtggaaagaaggcttgacgggaaaaaaggtgaaagtggctgtcattgacagcggcatttaccctcatgatgatctctccattgccggaggctattccgcagtcagctatactccctcatacaaagatgacaacggacacgggacgcatgtcgccggaatcattgcggccaaacatgacggatacggcattgacggcatcgcgccggatgtccggttatatgcggttaaagcattagacagaaaaggagcgggagatctcaaaagccttcttaaagcgatcgactggtcgatcgccaataaaatggacatcatcaatatgagcctcgggacaaacgcagacagcaaaagtcttcacgacgccgttgacaaagcttacaaaaaaggaatcgtgatcgttgccgccgcaggaaacgacggcaacaaaaaacccgtcaattatccgggcgcctacagcagcgtaacggcagtctcagcgtcaactgaaaaaaacgggctcgcagctttttccacgaccggaaaacaaattgagtttgccgcacccggcactaatattacgagcacgtatctgaatcaaatgtacgccacggctgacggcacatctcaagccgcgccgcacgtcaccggcatgttcgcgctgctcaggcagaaatacccggaggaaacaaatacacagctccggcagcagatgcagcaaaacgtcaaagatctgggcgctcccggacgtgacagccgattcgggtacggactggcgcaatatcacacaaaacaaaagagctttgccgaacgggccgtaataaaagcggaaaagacgaaaaagcaggcagatatcaatcaagcaaaaacggcagtcagcaaactgtccaagtcaaagggaaaaaccgctctcgaggcgcggatcaataaagttcagacggcaagaaatgtgacggacgcaagagacaaagtccggactgccgaaaaacaaaagaaaaaaaccgccgtcaatgccgcacaaagcgccatccgcaaattaccggccggttcagagaaaaaagggctgcaaaagcggctgaacgctgtcaactcaagccttttgagaacagctgaagccagcgtcaagcaggcggaaaaaaagacctctgaggccaacaccgcaaaagcccaaaaagcagtcagcgaaatccagccgggaaaagaaaaaaccgctctggaaaaacggcttggccggataaaagataaactcaaccggcagcaggcaagagacaaagtaaaaacggcggaaaaaaccaagacgaaaaaagcaaaatcagcggcgcaaacggcagtcagccgattgaagccgtctgccgaaaagaccagcctgcaaaaacgcgtgcgtgcgattcgggtgaaataataaaaaaaacgcttgtgagccggtcaacggcttcacaagcgttttcatcacacctgcctattggttcatggccgggcggtcaatcgtgttccatttcgtaaaggacatatatcggaaataatgatcacgatacgggtgcgaggtgcctgtattccaaggcttgtccccgccgcagaaatggacgatggccggttcggcacgtgtttctctgtaacgtatacggtcgatcagttcaggaggcgttttctcattcatgataatatgcgtctgcgcgttccagcgcggatgcagttcatgccattgatcatataagatcgcgttaagcgcgtcctgatcatgaaacacgagaaaatcctccgagctgttatcattgataaaatcaatcacttttttggaaatattctgttttctccaaggttcgaaatctataatcataataccggaattaaaatacttggcagtgtcgctgatattcatttttttcagtctttcatgctgtccggcatcttctaccgccgcaactattgccggggaaatatccaagtcccataaaaccgaaatatcttccatcacaattgcatcgcaatcgatgtaaatcatccgctttacggactcatccttaattaaatcagggatagaaatgcggtaataagccgcttttgtaatatggctgctttcgactgcatgcttgtattgatcagcgtctacttctaaaaattcaagcggcgtcccgaatgacatcgcagtctgttcaagcttgtccttgttttcggcagtaattccgccgtcgatcacatataatttggcattccttgttttatccatattcatcaataaagaagcgaacatcccacccaaatgacgagcataattatcatcggcacatgatacgatatgcattgtttcattctttcccactgatattcatctccctttttgttgtacaaatgtctttccctttttttaaaaagtaaacctcaatcttacacattttttctgcgggaatgtgctgtttgcgatttgatatctttcgcattctctgttaaaattcatttcatagctaatgattctgacaataataaggagcatgacgccattgacgattcgcaacgatgccggatcagacaataagaagccgaacaggcctttttccgatctatccggccgaaacaaagaggcggcctatattgcagctgcactctatcggtccgcccagcagctccgtgtaaaaatggagaaagaggtgctgtcggcacacaaattatcatggacggcgttttccatcctgtatgacctttgtgaatgggaaacgcttgatacaagaaggatagccgctctatccggaattacctcggcgacggcgagcaatgtcctgaacactttggaaaagaagggcttatgcagcagacaaacgaacaaaagagaccgcaggcttgtattcgtcagtattaccgatgagggcagaaaggttattgaagatctgtaccccgactttcatcagggggaaattgaactgacggcctgtctggataaacaggaacaaaaaacgctgtccgccctgctgcaaaaaatcgctgacaatttcataacatagcagctatgacgggaatcagtaacggattgtctccctgtttcagagagccggcggatggtgcaagccggcacaaagacaaacgtgaattacctccctgagctttctttgtgaacttcagtagcaaagaacgggaaaccgttattcgaatgagcggaagacgtcgtttcgtcttcaatcagggtggtaccgcgtgcatacagccacgtccctttttgggatgcggcttttttgtttggctaaaaaaaggaggatgtaaaagatggaatcaatcactttaacgaatgatcaggaaaaagaagtgcaaaggcagctggatttgtacatgaccggcgccgcggacgtcataccgcctgaagaattgagaaataaaatcgccaaatcagtggcatccggcaagccgctgaacattaaactcggccttgatccgtccgcacccgacgtccacttgggccataccgtcgtgttaaacaaactgcgccaatttcaagaaaacggccatatcatacagcttgttatcggggactttaccggaaaaatcggtgatccgacggggaagtcgcaagccagaaaacagctgactgatgaagaagtccaacacaatgccaaaacctattttgaacagtttggcaaggtgctggatcaagacaaagttgaacttcactgcaactcaaaatggctgaagacattgaatctggaagatgtgattgaattagcggggaaaattactgtcgcccgcctgatggagcgcgacgactttgaggagcgcatcgccatgcaaaaaccgatctcacttcacgaattcttttacccgctgatgcagggttacgattctgtcgttctcgaaagcgatatcgaactcggcggtacggaccagcattttaacgtgctgatgggccgccatttccaagaacgctacaaaaaagaaaagcaggtcgtcatcctcatgccgcttttggaaggtcttgacggcgttgaaaaaatgtctaaatcaaaaaacaactatatcggcattgacgagcatccgaacgacatgtacggcaaaacgatgtcattgccggacagcctgatgaaaacatatatccatttagcgacagacttagagcctgcggagaaaaaacagatggagaaggatttggaatcaggaaagcttcatccgagagatgccaaaatgatcttagcgggtacaatcgtcagaatgtaccacggcacgaaagcggcggatgcggcagagcggcatttcaaacgtgtcttccagcaaaacagcctgcctgaagatatgaaaaccgtcatatgggacggagaaaagaccgtgccccttattgagctgcttgtcacgcttggactcttttcttcaaaaagcgaagcacgccgtatgattcaaaacggcggaatcaaagtgaacggggagaaaacggatgcccttcataccgtcattaccgcagaagacggcatgacgattcaggtgggcaggcgaaaatttgtacagctgcgcataaacggataaacaaccagccggactgcacataatagcggtccggctggttgtgacgggtcaatcgtttaatcgacttctttcttaatcccaagcatcttttcgtctaaataatgggcgatgtccgccgcttccttcagctcgtcggtcagatgctttgggacttcgttatttaatttgtaataaattttgtgttcaaggctcgcccaaaaatccatggcgatggtgcggatttgaatttccgccttcacatattccacacgattcgttaaataaacgggaatttcaataatcaaatgcaggctgcggtagccgttcggcttcgggtttttgatataatccttcacctttacgatcttcaagtccttatgctgcttcagaacctcagcgacattataaatatcggaaataaaggaacagataatcctgacacccgcgatatcatgaatatgctctttcatttcctgcgtcgtcacatcgcagcctttgcgcatcagtttattgacaatgctttcaaaactcttcacgcgtgattttgtatgctcgatcgggttatgcccgtgaatcagattatattcctggctgatgatagaaaacttcgtatccagctcatctaaagcgaatttataaactaataattcatttttccaatcttccatgaccgttttcaaatcatccatatgggctgttgacaagtccatttttttcatctccttgctttgctgtccatatatgagacgggtcaatccgcggtcaggttctttacaatatcgtgaagattatgtcataaaaaaaagcaaatgccggttatagcatttgccctttcatttgatcagcggaaataactgatcaggagtccgattgaaagcaggaatccgaagaatgtattggtttgcgccgttgatttcatcgcaataatcatgttcatcggcatttcgtttttcacaaagcctttcacggcctgaacgggtttcggcacgctcaaaaagaccaggaacagccacgggcttgtgtaacccatgatgacaagaccgacgatccagatgtaagcgatggcaaaagatgccgccagtatcataacggcccctctatgccccatcaaaatggccagcgttttacgtccgccttttttatcttcctcaatatcacggatattgttggacaggttaatcgctccgaccagaatggcgatcgggatggaaatcaaaatgctctgttcattaattctgcctgtctgaatgaagaaagaaataaggacaaatacggagcccatgcaaatgccggagaacagttccccgaacggtgtatacgcaatcggcagcgggccgcctgtatacagatagccgatcagcatgccggcaaggccgatagccgcaagccaccagctgctgctcatgcagatataaacaccgagcacgagagcaatcgcataagagccgagcgccagctgcagaattgttttcggcttcatgccgtggcggacgatcgctccgccgataccgacggaatcctcggtatctaaaccgcgtttaaaatcgtaatattcattgaataagttcgtggcgatctggatccaaaggcaggaaaacagcatggccaaaaacagcaggaaatcaacctttacgtaaaacatcgccaatacggtgccgagaagtacgggcacaaacgatgccgtcaatgtatgagggcgggttagctgccacaaaatgcggcccatgctttctttctcgggcgtcttttggctgccccccatattgttttgattcattttcctcttcctttctattaaaaggctttcacagtcagccgataacagtagtgttgaattggggttttcacgttttctgctaccttatctatcataataatttcttcctcatttcacaagatgcggcgctttatcagctatcctgccggaaacagcttttcgcccttctccattggggttcggcacaagcctgcttaagaaaaagccgccaaattttttttacctcgtttaaatttacgataagttaaaaatcccgcctgaacagcgcctttttagtatgatcatttgccaatttatacatgcgtgttttccatccttttgtttctcattcatttttaaggaaattttaagcttaggatattagacatattttgaaactttttgttaatctaatcgtcatatactggtgtaattattgaatacgcggggaaggaattttgaatatgatgcaaaaattaaaacgtgcttatgaaaatacattgatcaaatggacgtttcatacgggcttttattttctgatattagtattgctcttttggatgtatggatttcatacagcgaataccggcacttatatttacaacgatttctaatcggggaggataactatgaaactacttgatgctataaaaacatacgcagacgccaagccgcaggccgaagcgtttcgttccttagatcattccctcacttacggggaattatgggatttgtcggagcgggttgcgtccggcattcaaaaacatacagctgacggttcgaaagcgcctgtcctggtttacggacatatggagccgaatatgatcgtttctttcttgggaagcgtcaaagcgggccgcccttacatccctgtcgatgtttccattccggcggagcggatcgtcaaaatcattgaaagctcaggcgcagagctgcttatcagcgtatcgggcgatgcagtcgatacgggaagcaatctgattaaaaccgttacgcccgaagagcttgcagctgacggagatgcagacctcagccgtgagaactgggtaaaagagctggatacgttttacattatttacacgtccggcagcacgggaaatccgaagggcgtgcagatatcggctgataacctgcaaagcttcactgactggatctgcagggattttcctgtgggcgggggtaagacattcttaaaccaagctccgttttcttttgatttatctgtcatggacattttcccgtcgcttcaaacgggaggtacgctgcactgcgtaacgaaagacaaaatcaataaaccgaaagtactatttgaagagctggagaaatccaaactgaacgtctggacatcgacgccgtctttcgtccaaatgtgtctgatggaccccggctttacgcaggagctcctgcctgaggcagaagtatttatgttttgcggagaagcgcttccggctgccgtggcacaggaactgttaaaccgttttccgaaggcccgcgtattcaatacatacggcccgactgaaacaacggttgccgtcacctccgttgaaattacgcagcagattatcgatgaaaatgaatctctgcccgtcggttttgcaaaacccgatatgaatatcttcatcatggatgaaaacgggaataagcttccggacggagaaaaaggggaaatcatcatcgccggcccgagcgtgagcaaaggctatctcggtgaaccgtctctgacggaaaaagcgtttttctcaattgacggccagtgggcatatcacacgggtgatgccggttatgttcaggatggtcagattttctgccaaggacgccttgatttccagattaagcttcacggctaccgcatggagctggaggaaatcgaagtacatgtaaggcagtctcaatatgtgcgcacggcggttgtcatcccgtatcagcctaacggaccagtcgaatatttaattgccgccatcgtgcctgaaaaacatgattttgaaaaagaattccagctgacaagcgccattaaaaaagaactggccgcttcgcttccggcctacatgattccgagaaaattcatttatcaggatcacattcaaatgactgcgaacggaaaaatcgaccgtaaacgcattggcgaagaggttcttgtatgacgccttacagctcgtttttcttctttatcttacttggaatccttcttttgccgacgattattttagggctgaacggcaagagattccaaggatacaacatgtttatatccatcatcgtattggctttgattttcgcgcatgatctgcacggcgtgatcgcactatgtatctttacgctgtggcaggtgcttttaatcaggggttatctcgcttacagactgaaagccaacagcggctttgtcttcagtatggccgtgatcgcgtccattttacccctgtttttatctaaattatggccgtttttcttcccgccggcgcctcatcatccggttcataacctgatcagtttcttaggaatttcttatttgacatttaaaggcgtccagctgatcatggaaacgagagacggactgattaaagaaaaaatgccgcttcaccgccttttgtactttattatgtttttcccgaccatttcttccggtccgatcgacagataccgcagatttgccaaggacgaacagaaagtatggacaaagggagaatacgctgatttactgtataccggcattcataaaatttttatcggtttcttgtacaaattcattatcggatatgcgattaacacgtatttcattatgaatctgtctcatatcacccacagcaaactgtggggtaatgtgctgtacatgtacggatacagcttgtacctgttttttgattttgcgggttacacgatgtttgccgtcggtgtaagctatatcatgggtatcaaatctccggaaaactttaataagccgtttatcagcaaaaacattaaagacttctggaaccgctggcacatgtccttatccttctggttcagagactacgtatttatgcgctttgtattctggatgacaaagaaaaaatggataaagaaccggatggccgtctcgaacatcgggtatttcctgctgttcatgctgatgggcgtctggcacggactcgccctgcaatatattatatacggcctttaccacgccgtattaatgaccgggtataacttttttgagaaatggaataagaaatacaagtggctgcccgccaatcgttttacggcctttttagccatcgtcatcacattccatttcgtatgtttcggattttatattttctcaggaaaaccatttcatcactaaaggagattgaaaacacatggaatttaaacaggaagtattagacgtattagctgaagtttgtcaggaggacgctgtgaaagaaaatcctgatattgaaatctttgaagaaggactgcttgattctttcggaactgtagaactgcttgtcgccatcgaaaaccgcttcggcattacagtgccgatcactgaatttgaccgtgacgagtggaatacgccaaacaacattgtaaacaaactgactgagttgaagtaaatgaaaaagcgtttctttggaccaattattttagcgtttgtcctgtttgtcggagctatcgcagttccggcttcatggcttacgcgcttcattcctgaaaaacgtgtcgaagagtcggcggcggccttaaatccgaatatgttccagggcctctatctgcaaaacaaaatgttcgaagactcgaagtatatgccgattttcggttcttccgagctttcaagactggatgagtttcacccgtccaactatttccaagtgaacaaccaaggctttacgccttatcttgtcggaaaaggcggggaccaatccttgatacacgccgtgaactttgcggcgcattatcagcagctgaagggcaaaaagctggtattcattgtttctccgcaatggtttatcaaaaaaggttctgatgaacagcactttgcgccgaatttttcatcacttcaggcattggatttagcatttaataaccagattgatcccgcggtcaaaaagaacatgatgaagcgcatgctccgttttaaagttgttcagcatgatgccgtcctttctgaattatacaagggaatggtcaacggacaatcatggaaagtgaaagcggtcatgccggctgccaaagcttattattctctgcttgagaaaaaagatctttattattcaatgggagaaaccaagggccctgaacggacgatctctgaaaacctgaaagggaaatcgtggtcagagttaaaaacagccgccgctcaattaggagaacggagctccacgtccaatcctttctatatcgatgacgcttcttataaaaagattaagaagaaagtaaagagagtgaaaggaatcaacaaaggaagaacgtacgccaaatcagtcgaataccacgactttgaggatatgctggacattctgaaagatgccggcgctgaaccgatgttcgtagttattccggtcaacggaaaatggtatgactacaccggcttcccgaaaaaaggccggactgattactacaaaaaagtcactaagcaaattaaagcgaagggctttcaggttgccgacttatccgggcacgaatatgatccgtactttatgaaagacaccatccatatcgcctggaagggctgggtgtacgtcgataaagcaatggagcagttttacaaaaccggcaaggtgacggttcactgagcacggtgatgacagaatacgtaaaaacgaacacgcagggggcattctctcccctgctttttatgtgatttgattttttcacaaatttgaggaaaactattgcgaatatttgttgaaggtatacaatagaatataaattattttcaaataagtttgacaataacaccaatagggagacagaacattatgaaacaagacattcgtgttgaattgacttcagccaaaaaaccgaaaccggacccccataaccttgcgttcggcagaattttcaccgaccatatgtttgttatggattacgacgccgatcaaggctggtatgatccgagaattatcccttatcagtccatctcaatggatcctgcggccatggtttatcattacggccaaaccgtttttgaagggcttaaagcgtatgtaacgaaggatcaggaagtgcttctgttcagaccggagaaaaatatggagcgcctgaaccagtcaaatgaccgcctttgcatcccgctcattgatgaagagcttgttcttgaaggcctgaaacagctcgtagccatcgaccaagactggattccgaaagcggaaggcacttccctttatatccgtccgtttattattgcgactgagcctttcctcggtgtagcggcatcccatacgtacaagctgtttatcattctttccccggtcggctcttattacaaagaaggcattaaaccggtaaaaatcgccgtggaaaacgaattcgtgcgcgccgtcaaaggcggcaccggaaatgcgaaaaccgccggcaactacgcatcaagcctgaaagcgcagcaggttgcggaagagaagggattttcccaggttttatggcttgacggcattgagaaaaaatacatcgaagaagtcggcagcatgaacatcttcttcaaaatcagcggcgaaatcgtgacgccggagctgaacggaagcattcttgaaggaattacgagaaattccgtcatcacccttctcaaacattggggactgactgtgtctgagcggaagatttcgatcgatgaaatcatccaggcgcatcgtgacggccgattggaagaaacattcggaaccggtacggcggcggtcatttctccggtcggcgaactgatctggaatgatgaaagtcttgtcatcggcagcggtgaaaccggagagatctcgaagaaattgtacgataccattacaggcattcaaaaaggcgcggaagccgacgtgttcggctggacgacgaaagtcgcctcactaagcgaatcaaaataagcaaaaaacccggaagcaaatccgggttttttttattgctcttatgcttcaatcgacttaaagaaatggggcagatgttctttgtgagcctcaagcatttcatccagaatggcctttgccacggagtctgacgggacaagagggttgatcgtcatcgcaagaagcgccgtttgataatctcccgtgacggctgcttcagcggcgacgcgctcaaatgatttgatttgctggacgagtccgcggacagacaccggcagatcaccgacggcgatcggtttcggaccgtctttcgtcatgacgcagttcacttcgaccgctgagtcattcggaatgctggcgatcgcgccgttgtttatcgtattgacgggctggatatcatgtttgtcgttatagatggagctgatcaggttgcaggccgcgtcactgtagtacgctccgccccgtttttccagctgcggcggtttgatggcgagattcggatctttgtacagttcgaacagttctttctcaaccttctgcacgacctcggcgcgtgtgccctccgtctgtgaagcttctatttcatgctcgagcatttctttcgttttgaaataatagcggtgatagccgcaaggaatcagatcgagcgccttcaggaattcaggctcccattccgctccggaaatatttttcatcgtcatggcgtttttcgggtctcccatggcttcaatgacttgatctttcacgctgacgccgtctaagaaaacatctaacccgaagaccatgtgattcagtccggcaaattgcacttcgatccggctgacatccacatccaatgcttttgcgacgcccattttaatgccgatcggcacattgcagaggccgacgacttttgtgagattcgagtagcggagcaaggcctcggtaaccatgccggcagggtttgtgaaattcacaagccacgcattcggacaaagctcttcgatgtctttcgcgatttccagaataaccgggatggtgcgcagccctttgaataaaccgcccggaccgtttgtctcctggccgattacgccgtattttaacggaatccgttcgtctttggcgcgggcctcaaggagaccgacgcggaattgagtcgttacgaaatccgcatccttcaaggcttctctccggtcaagcgtcaggtgaatctctatcggaacacccgctttttcgaccatgcgttttgcaagcgtgccgacgatattgagttttttctcgccttcgggaatgtcgacgagccataattctctgacaggcagttcctcatagcgcttaatgatgccttccacaagctccggtgtatagcttgaacctccgccgatcgttacaattttaattccttttgtcatatttttgctcccccttgcagactcactttttcgtaaatctcgactaactcagcggccaagtctttcacggtcatggcattcattaaatgatcctgcgcatgcaccattaaaagcgtcatgtctgttttttctccgccggcttcattttggatcaattctgtctggtaatgatgggcttcggtcagttcccttgcggcttcctgaagcttttcctcggccatggctctgtccccctgctttgcggcggcaatggcttccattgatgcgcttctgccgttgccgccatgcaggatgatctgaaaaatggtctgttccattttttcattcatgtgtttcactccctttctctacagcacggctttttcgtctccctgtacggctggcgcctgcgattgttcaagttcgttttcttctttcagcttttgcgaatcccacattctgaagaacggatagtacacgataaaggctgtgatgatattaatcgcctgcatgacagcccctgatatttttccgccagtggcaagatagccggagaaaatcggcggcatcgtccatgggacggcaatgccggcaggtttggcgacgaggcctgtgctcatgccgatataggtaaagaccagtgtgacaagcggtgtgatgatgaacggaatgagaagcatcgggttcatgacgatcggcattccgaaaataatcggctcattaatattaaagacagccggcccgatggcgagtttcccaagctgcttcatctgcttgcttcgcgaacggagaaacatggtgaccacgagcgccagtgtcgcgccgcttccgccgatgttgatccagatttcaaagaactgctgggtgaaaatattcggcagcgcatcgcctgcctgaaacgcaacacggttggcatccatcgctccgaaccagatcggcgccatgacgccgccgacaatgttcgccccatgtaatccgcacgcccacaaaagcatttgaaccgcttcggctaccaggcttccgccgagacttcccccaagaatcgagagcggcgtccccagtacaacgcttacaatgttatgaaggctttcaaacggcgtcgcttcgacaattaaacgcgcaccccagatcagaaagatgacggcaaagccgggaattaaagcgacaaatgatttgctgaccgccggaggcacgccgtccggcattttgaagacgaaattccgctggatgatcaggcggtaaatttccgtcgacagcatggcgatgatcatcgcgacaaacagccctttgcttcccatgagagacagcgggatgccgccgcccaccatgatttcctcttttgcgccggaaggcagaaacggaactttgtacggcgttgccaagagaaacgccgccaaagatatcgcaccggccgataatgcgtccaccccgtatttttcagccaggcggtaggcgattccgaaagcggcgacaaggcccatgatttcaaaggtcgcatcaaccggatattgcagtttttgagaccaggcgcttccgaacgtcttcgccatgaaatccgcatatcccggaatcggcaggttgccgatgatcagaaaaaatgaaccgatgatgataagcggcatggtgaggatgattccgtcacgcagtgcttgcagatgccgctgggaggcaatttttccggcaatgggcatgactttctcttctaaaaactggttcaccttattcacacggcccgcccctttctacgatgcgtttccgagctgttccgctgatttcagaacctccgctccgttgcaagtgccgtaatggacggtattgatgacttcaaccggcactccttttgattcacccaattttttcagctgcggaagcaaataacggacttgaggcccaagcagcaatacgtccgctttatcaatatgctggttgactgaatcgcctgacaccgcccagattttatattcttttccttgttcctgcgcgcttttttccatcttggtgacgagtaagcttgttgacatccctgctgcacaaacgagtaatatattcatgtaaaagacctcctgaaagtttgatattttgtatgtctcgatgttagtaacatcatattatgaaatcgctttcataactactcaggctttttccgctgctaacggaaaaaaggtgtatcccggtctttctctgatcgtttgtctctgaatactcgtaaaacctcctgataggttgtgcattttaagagacggcttaccgcggccggatcatccaacatgccgccgagccatttgtacatatgctggaggtcggctttgctttctttctcgacgcagagcagacagacaaattggacacgcttatccgcccagtcaatcggcttcttcagcgtgcataccgcccaaaacgtcgtgtctgtctgcggaacgagcgggtgcggaatcgccgtaagattgccgaaactcgtaggagaaatcgcttccctttcaaaaatagaatcggtcagagaatcagaagcgaggccggcttctgcaacctgctgtccgagaaaacggatgacgtcctccttcgtctccagatcctgctgcaaaaataccagctccggtttcagaaagttcaattgttcccgattttcttccagcatggcgtcgatttttgtaaaatccccgccgcccagcagcgtatgaaccttcaatacgggaacgggcaggtcttttttgatcggcactgtgctgaccacaaaatcaatcgactcaaaggaaagctggtcaaggctgcagtaatcagccgttccgacgatttcaagacgttttgcgaaccgggaacggagcttttctcttaaaagctgcgcgctgccggcgccggacgcacagacaatcagacagcgtttaggcggccgttccgtctttctcctttcaatcgcggctccgaaatgaagcgccaaatacccgatctcattttcatgaatatcaatgccggtttgctccttgatcacgattcccgcaatcactcccgcttcaaatgcgagcggataattctcctttatggcggagagcatcgggtttctcaggttcattccgtaccggtttcggttaatcgccggcttgatatggagcgcaagacccgctttcagctcattgtcgtccgtgattccgagcttcagctcccgctcaatggcttcaatcatggcctccgtcaaacggcaggtttccccgtctatcagccttgtaagctcttttccttccatttgtgactgggtcatgcgctttgtcccgagcaggtgaatggcgatataggcggtttcctgttcgggaaaggtgaccgaaagcgcagattcaagctcttttacaatggcttccgctgactgatattctgtttcgagcttaatatcatgaagatcttccggaatgagagatacatagttttctgtccggattcgtttgcaggcaatggcgatatggatgatgagattgttcaggccgaagaaagaaagcgggatcttatggtttcgaacctgcttcataatggctgtgcggatcacatgaatgtcgtctttcggcagaataccggccttttcactcaggagatcaggctcgggctcgcggtcgtccactaagtattccgccatacaataacggaggcggagctcttcgccgcgcagcttaaagccgtagttcggccttgtttccaaaatgatgtcataggggcggagccgttttttgacttcttttaaatcagattgaagtgtggatttactgatgaacagttcttccgccaagtcatccagcttgaggtagccgtcggccagaagcattcttttcatcaggtaatctatccgttcatctggaaaaatcggcacggtgctgttctgctggaaattgtcctgaagccagtttttaaacggctgctcattccggatcagcagcttatagccgctccctctgacagattgaatggatgcgccgtgtttttctacaatggtttgcagttcctttatgtcattgcggaccgtccgcgtcgttacctttacatttgcagcgatgactgagcttgtaaccggtgtttcagcagctaaaagcaagcgcagaagttcacgaagccgcccatgaagcatgagaaaaacctcctatcagatcagatgcagatgtgaaaaatgggcaaaaagaatgaggaaggggtaaatgtatgtaaattctatactggggaggatttcaagtcaatgcggcaatccgatgccaagaccgtaaaaaaacagccggatcagccggctgttcgggatgcggacatgcggttccgcttagatgccttccgttcttttatgatttttctgataatcggatagatgacgggcgcccatttgataatcgttttgaaaaattttttcaatgtctgaatcccctttcttttaccttgtctttcccctgttatcagcgtttataaacatggtcagcgtgagacataccggttccccgtcacccaatagcgccacggataatcccgggcttctccgctgttgtcaatcccgattctcgggcctgttgatatatgttcaggcgtaaagccctccgtaatatacagcggcggttccgtgatcatgccgccgtagtcgttcattgaaatgcccatcgccttcgtcagttttcccgggccgtttgtccactctctcgggggtctgcccggtctcctgctctccatcaggaactgtccttcatgaggctccgccgccctgattaacacggcctgcggaatgccgatgtccgcggcgacgacgttcattaatgtatgagtgtgcatgacgtatgtataaatgcggcccgcctcatggaacataatttccgtccgtttcgtgcgccggttgccgaaactgtgcgccgcccggtcatccgctcccatataagcttccgtttccacgataaaacctgaagccgttccctcatccgtctccttcaccaggagacagccgagcaataaaggggcaagctccactgacggtctctggtaaaattcaatcggcaaaggctttccttctcccgccatttgcctccctcctttctgaatatagcgatttcctctttcacgtttttcacttcttttttacaatataaacatgaaagaaaaaagggcatcattgttgaacactctattgcgttttgaaaatcggcccggtataatatgatggttcaaatgaaaatgattctcatattcaataaatgccggacaatgatcataaaagtaggtgaattgatttttgagcgattctgtcacgtccgcaagccgtctgatcagcatcttaaaaaacggggttttcttcctgatcgcggtggtcgggctgcttgtttctatttttttcgccgtctcattcggcgcgaaagacattactttacatacggtttggtcggctgttgctgattacaatccgaacataacgggccagcagatcattcatgaattgcgtcttccgagagtgctcggcgcggccgttacaggagccgcttttgccgcagccggcgccctcatgcagggtgtcacgagaaatccgcttgccgattcgggtgtcttaggcgtaaacgcgggcgccatgtttgttgttgcgctcagctttgcttttttccctcatttgtcatacgccctgctgatggtgatgtcatttttgggagcactggcaagcaccggcttgattttctttatcagtgcggcgggaaaaggcagcatgacacctttaaaggtgacgcttgccggggcggtcgtggccgcgcttttacattcactcagtaccggtgtagcgatttattacgatttaagccaggatttggccttctggtacgccggcggggtgtcggggatcaagtgggctcatttacaagtccttgttcccgtgattgcggtcttcatcattctcgcgacattcatgggcaggtccgtcacccttctctcaatgggaaatgacgtggcggcgaatttaggggtgaacacggctctgacgcgtgccgcgggattaatgatcgccgtcgttcttgccggtgtgtctgtttccgctgccggcgcgatcggctttgtcgggctggtcattcctcatatcgcccgcaagatcgtcggcgttacgtacaggctgattattccgatgtccgcgttgctcggcgcgattcttttgattttggccgacttggcctcacgcacggtcagtcccccgagagaattggcgataggcatcatggtggcacttgtcggtgtccctttctttctttatattgcccgcaaggaagggagagacttataaatgaaagtgcagaaagaaacaaaaaaagcggcggcggcaggtctcgttctgctggtcatcgccgtttgcattattctgatcgggctgcacacgggctcattccggctttctcccctcaccgtgggaaaaacgctgttcggatacggcacgtttcaaagcacaaccgttttattcgattaccggctcccccggatactggtgacgatgctggccggtatcggcttaggcgtgtcgggcgctattttgcagggtgtatcccgaaatccgcttgccgatccgggcattctcggactgcatgccggcgcttccttcggtttgatgatgtatatcacattctttcattccctggaggcgcaggcgtcgatgttcatcccgctgtttacgtttgcgggcggaacactcgccgccctgctgatcgtagtgcttacgtacgacaggctgaacggttttttaacgatccgcatgctgttggtcgggatcgccgtttccgcgggcttcagcgccgttacattgtttatgtcgctgcgtctgaatgaagaaacttataccttcgcttcccgctggctggtgggaaacgtctggggcagggattggattcacgtgtggtcgctattgccctggatcggcattctcgcaccgcttgcatggcttaacgcccggtctttgaatattttaatgctcggtgaccaggcagccgcggggctcggcgcacacgtgcagagaaaaaggatcatgctgatcgccatagcggtcggcttgtcctgcgcgagcgtcgcgatggccggcggaatcggctttatcggctttgccgcccctcacttggcaagacggctcgtcggcaccatgcatcagcatattattccgattgctggattaatcggccttgtcattcttgtcgcggcagacaccatcggccgatctttgtttcagccgaacgccattccggccggcgtggttgcagcagccatcggcgcgccgtattttctctatctcgtcatgaaaatcaaatcataaaacaaggagtattcccatgaaaaaaataattgcgctcatcagtttcatgtgtattttcttactggctgcctgccaatccgattcatcacagccggagtcaaaaaagaaatccggcgatcataaaatcgcttcgatgtccattcacctgacaaatgatctgctggctctcggcgttacacctgccggttccgtcgtgggcggagaattaaaagattttctccctcatgtgaaaaatcagctgaaagacacgaaaaaactcggacctgcctcagacccggatatggaagctttacttgagctgaatccagacaacatttatcttgataaagaatttgcgggaaaagatgtgtctaaatacaagaaaatcggaaacacacacgttttcgaccttgataaaggcacatggcgtgatcatttaaaagacatcggaaaaatcgtcaaccgtgaaaaagaagcgaaaacatttattcaagattacgaagatgaaacaaaacaagtcagatccatgatgaataaggaattagggaaaaacgccaaagtcatggcgatccgcgtgaacgcaaaagagcttcgcgtcttcagcacacgccgcccgatgggaccgattctgtttgacgatctgaagctgaaaccggctgacggcattaaagaaatgaatacctcccgcccttatgaagtcatttctcaagaagtgctgcctgattacaacgcagatgcgattttcgtggtcgttaacagagacgacaagtcacagcaagcctataaagaattgcaaaaaagcgctgtctggaaagggcttaaggccgtgaaagcaaaccatgtctataaaattgccgatcagccttggcttgattattcggcactgggaaataaattagcaatggatgaagcgaaaaaactgttccaaaaataaacatgagccggttttgcaaaaagtgcaagaccggcttttttatattaccgtttacttatataaacatctgcttatataatagtgtaaaaaaggagtgagcgcatggaacggcggcataatgctttaagttccgaagggatcagccagtgcctcaaacttctaagcgacccgacgaggcttttgatgctgaagcttctggaggataaggaatattgtgtctgcgagctgacggctatttttcatataagtcagcccggcatcagccagcacttgcggaaattaaagaacgccggccttgtgcgcgaaagacgcgagggccagtggcggtactatgccattcatccgtccggaccggaatacgcgctggtctgctcgattctccagcagatagatcaaaaggacgaagttttacagacattgcggcaaaaagaagtcactgttacatgccggtaagggggatatattcttgggagttgcggttttatcagcgctgatttttgtgctgacacttgtgtttgtcatatggcagccgaaacatatatcaatcggctggtctgcctgcggcggagcggtcctcgctttgatcgccggagcagtcagcctgcacgatatcgcggaagtgacggggatcgtctggaatgcgacactcgcctttatcgccattattatcatttcattaattcttgacagtatcggtttttttgagtgggccgcgctgcatatggccatggcggccaaaggcagcgggctgcggatgtttctctatgtgtcggtcttaggggctgttgtctccgccctgtttgccaatgacggagcggcgcttattttgacgccgatcgtactggcgatggtgcgggctttgaatttacctgaaaagctggtttttccgtttattatcgccgggggattcatcgccgacaccacctcgcttccgctcgttgtaagcaatttggtcaatattgtatccgctgattactttcatatcgggtacattgaatatgcatcacgcatgctggtgcccaaccttttttctctggcggcaagcattttggtgctgtatctctatttcagaaaaaacattccgaaacggtatgacaccggtcttgtgaaacatccggcatccgcgattaaggatgaacgccttttccggttatcgtgggctgtgctggccgttttattgatcggatatttcgtcagcgaactgctgtcgatacccgtttccttcgttgccggctccatcgcggtcatttttctcattctggcgcagcgaagccccgccgtccctgcgaaacaagtcatcaaggacgccccgtgggccatcgtgtttttttctgtcggcatgtatgttgtcgtgtacggcttgcggaatgccggactgacggatcttctttctcagcttattcagaaagcggcggatcacggattgtttgcgggcacactcggaatgggttttatcgctgcgatcctctcctccgttatgaataacctgccgacggtgatgattgacgccatagccatcagcggaacggacactcacgggctgatgagagaagcattgatttacgcgaatgttatcggttctgacctcgggccgaaaattacgccgatcgggtcgctggcgacattgttatggctccacgtgctgagccggaaaaacgtgaaaatttcctggggaatgtatttcaaaacaggtctgatattaaccattccgacgttattcatcaccctaatcggactttatttatggctgttatggctcgcttgagatgaaaaaccttttaagttgaatcttaaaaggtttttttgtgtcaaaaatccgaaaagtaaaacttttatattttaaaagtatagacatttaatttcaaaagattataatattcatgaaaacgttttaactttatgaaagaagggattcctcatgaaaagaattttattagcctgcagctcaggcatgtccaccagccttcttgtcacgaaaatgcagaattacgccagctccatcggtgaggaggccgagatttgggcagtcggacaggataaagcaaaagaagcgatgaaagacgcagacgtcgtactgatcggcccgcagatgagttttttaaaaggcgagcttcagaaagaggcggacccgcttcacatcaccgttgatgtgattgatatgatggcatacggcatgggagacggcaaaaaagcatacgaacaggccgttgccttgatagagaacaaataaaggaggcgataagcatggaaacgtacacggatgaacagatcagttttcagctgattcttcacagcggcaatgcccgcagctgtattattcaatcgatacgcgcttataaagacggccggccagatgagtcagacacctttctgacaaaggctgaagaagaactgggaaaagcgcacgacatccattttcagatgattcaaaaagaagccggcggcgccaagacggatgtctccctgctttttatgcatgctgaagaccacttaatgtcagcgctctcaatgaaagagatcgtcaaagaaatgctcgacttatttcaatcaaagaatttataaaaagccgggggtgaagacgtgtttgagaaaatcagccaattccttgttccgatcgcgggcaaattaaacaataaccgctacctgcaagtcttacgggatgcttttatgctggcgtttccgctgaccattttcggttcggtgttcgtcgtgctgacgaacctgccgtttttaaacaaaatcatgagcagctccgccctgtctgtctttcaatccggatttggcggcgcttcgacggcgacgatggggattatgtccatttttgtcgtcttcgggatcggctattatctttcaaaaagctacgaagtggaggccgtattcggcggagcgattgcattggtttcttttctgctgctcaccccgttcgtcttagagccggaaacgggcaaagcggtcgcaggcgtcattccggttgaccggcttggagcaaaagggatgtttctcggcatgataaccgcttttttgtcgggtgaaatctacagaagaatcgtccagagaaacttaacgattaagatgcctgccggtgttcctccggctgttgctaaatcgttcgccgcattgattccggcttttatcacgcttaccgtcttcctcttgatcaatgcggctgtcacccagatctttcacaccaatctgcatgatgtcatttatcatacggttcaagccccgcttgtcggacttggaagcggcatcattcctacattaatcgctgttttctttattcagattttatggtttttcggacttcacggacagatcattatcaattccgtgatggacccgatctggaatacattacaggtcgaaaatttggctgcgtatacagcgggaaaagagattccccatattatttctaagccgtttatggagatttacaccgtcggaatgggcggaaccggaatgacattggccatagtgatcgccatcttgctttttatgaaaagcaaacagatgaaacagatatccaaactcggtctcgcgccgggcattttcaacgtcaatgagccggttattttcggtttgccgatcgtgatgaacccgatcattatcattccgtgggtgatcgcaccgatggttgtcacgctcgtcacctacctggccatgtcggcggggatcgtgccccctcctaccggcgtgaccgtgccctggaccgttccccttttcattaacgggattatggcgaccaattccgtcatgggcggcattatgcagctggtcaacctctgtattgtgtttattatctggttcccgtttcttaaagcgctggacaaattaaacatggcaaaggaaaaagaagccgaggccgagcagcatgaacgggatgacagcatgagtatgtaatcaaaatcgcagtaagggagagaaatcaattgactgaatcaaatattcaatatcgttttccggaaggattctggtgggggtcttccgcctccgccacccaaacagaaggcgccgccgacagagacggaaaaagccaaaacatatgggattactggtatgaaaaagagccgagccgtttttttaacggcgtcggccccggcgacacgtcacgtttttatgatcaatacaaggaggatatccggctgatgaaagaaatcggccacaactccttccggctgtctatttcctggtcaagattgattccggacggaactggagaggtcaatcagaaagcggtcgcgttttatcaggacgtcatcgatgaaatgcttgcccatcgcattgagccgtttgtcaatttgtttcactttgacatgcctctcgcccttcagcgtaaggggggctgggtcagccgggacaccgttgacgcgtttgaacattacgccaaaacatgcttttcgctattcggtgacaaagtgaaaaaatggttcactcacaacgagccgattgtgccgattgaaggcggctacttatacgactttcactatccgaatcacgttaattttcaagaagcggtgcaggccggcttccataccctgctgtcgaatgcaagggctgtcaaagcctacagagaattgaaacaggacggacaaatcggaatcattctgaatctgacgccttcttatccgagaagctcacaccctgaagatctgaaagcatcccggattgccgacgcctttttcaaccgctcatttttagatcccgccgtaaagggcgaatttcctgaggagcttgtcgagattctcaaggcggaaggctttctgccgcgttacgagaaagaagatctccgcctcattcaggagcatacggttgacctcttaggcgtgaactactaccagccgagacgcgtcaaggcaaaagaacatgttccgaatccgcacgcccctttcctgcctgagcgtttcttcgatccgtatgttatgcccggacggaaaatgaaccctcaccgcgggtgggaaatatacgaaaaaggaatctatgacattctcaccaatctcagagaacattacggaaatatcgaatgttttatttccgagaacggcatgggagttgaaggcgaggaacgcttccgcgatgaaaacggcatcattcaggataattacaggattgaatttatccgggaacatctcaaatgggtgcatcgggccatcggagaaggttcaaatgtaaaaggctatcacctgtggactttcatggacaactggtcttggacaaatgcttataaaaaccgctacggctttgtatctgtcaatctggaaaacgggggcgaacggaccgtcaaaaaaagcggccgctggttcaaagccgtttccgatcaaaacggattttaacagatgaggaggtacggccatgcttggaggtattgaagccggcggcacgaaatttgtctgtgccgccggacaaaaagacggcaccattctggacagggcggagtttccgacgggagaaccggatgacacactcagacaagtcatccgttactttaaagatttcccgatagaagccatcggcatcgggtcgttcggaccgattgacatccgccccgacagtcaaacatacgggtgcatcaccgcgacgccgaagacagcctggcggaactgccctattcttcaaacgatcaaaagcgcactgcatattcccgcaggcttcaccaccgacgttaatgcggcggcgctcggagaagcttctttcggcgcggccaaaaacacggacagctgcctctatttgacggtcggcactggcatcggagcgggcgccatcatgaacggcagatttgttcaagggctgtctcatcctgaaatgggccacatttatgtcagaagacacccggacgacggctacaaaggcaattgcccttaccatacagattgcctggaaggcctcgcggcaggtcccgccattgagaaacgctgggggaaaaaagcatatctgctggcggatcagcaggaagtgtgggagcttgaaggctattatattgccgaagcgcttgtgcagtatattctcatactttcgccggaaaagatcattctcggcgggggcgtcatgaaacagcatcagctgttctcttatatccgtcagcacgtgaaaaagcggctgaatcaatatattgatctgcccgacattgaacacttcatcgttccccctcaattaggaattcactccggcgcggccggttcgctcgtattggcggagcgcgcattagagacggcaaaccgggaggcgggaaaatgatgaaactcttatttttggaaccggtttttaaagaaagattatggggcgggacgaagctgcgcgatacattcgggtatgagattccttctgagcggacgggagagtgctgggcgatttcagctcatccgcacggtacatccatcgtgcggaacgggcctttttccggaacatcattacaccgtctctggaatgaacaccctgacctgttcggacatccgaaagaagacgcttttcccctgctcacaaaaattcttgacgcaaatatggacttatccgtgcaggttcatccggatgacgcatatgcacatcggcatgaaaacggagaactcggaaaaacggaatgctggtacgtgttggactgcaaaaaagacgcggagctcattttagggcaccgcgcccaaacaaaagaagatttcgttcggctcattgaacgaaacgagtgggatcacctgctccgccgcatccccattaagcccggcgactttttctatgtcccgagcggcacactgcacgctttatgtgaaggtacgctcgtccttgaaatccagcaaagctctgatgccacctaccggctttacgactatgaccggacggatgggaacgggaataaacgcgagcttcatcttcagaaagtaattgacgtaacagacattccccataccgatgaaaatgtaaaaagcactaagcatcggatcggagatgctcttattacgatactcgccgaaacacctttcttttcagtttatcaatgggatgtgagcgggaaagcatcattgcccgcacccggccggtatttactcgcaagcgtcattaaaggacgcggagaactggatggatgccccgttcacaaaggcgatcactttatcgtgccggcggattccggagattttgttatagaaggagattgtgaggttatcgtttcacatccttcatcatcttaaaaatcaggaggtcttttatatgcttaaaaaattagcagtctgcctgtctatcgttttattactcttaggagccgccagtccgatatcggctcacaccgtttatcccgtcaacccaaatgcccagcagacgacaaaagatatcatgaactggctggcccacctgcccaaccgttcagaaaacagggtcatgtccggagcgttcggcgggtacagcgatgtcactttttcaatgacagaggaaaaccgcttgaaaaacgcgacgggacagtctcccgccatctacggctgtgactatgggagagggtggctggaaacagcggatatcaccgatactatcgattacagctgcaacagcagcttaatctcatactggaaaagcggcggcctccctcaggtcagcctgcatctcgcaaatccggcctttccatccggaaactataaaacggccatctcaaacagccagtacaaaaacatccttgacccttcaactgtggaaggaaaacggcttgaggcgctgctcagcaaaattgccgacggccttactcagctgaaaaatcaaggcgtcaccgttctgttcagaccgctgcatgaaatgaacggcgagtggttctggtgggggctgacaggctacaaccaaaaagacaatgagagaatctcgctgtacaaagagctttacaagaagatataccgctatatgacagagacaagaggattggataaccttttgtgggtgtattcgccggatgccaacagagactttaaaacagacttctacccaggctcatcttatgtggatattaccggtctggacgcttacttcactgatccgtatgcgatatcaggctatgatgaaatgctgtctctgaaaaaaccgtttgcctttgccgaaaccggtccgtccggcaatatcggaagctttgattatgctgcttttattaatgcgatcaggcaaaaataccctcagaccgcgtactttttgacatgggatgaacaattaagtccggcggccaatcaaggcgcgcaaagcctttatcaaaacagctggacgctgaacaagggcgaaatatggaacggcgggtccttgacgccgatcgcggaataaccgcttcttttgaaaatcggttttaaaaaacggctctgctgggcatattgttaccgttcaaaaaggagggttcaacaatggcaaataacaaaaacagcgaagaaacgctttccagtaagacgaccggtaaaggcgagtcagaagacacgctgacaaaccggcagggccatccggtcactgacaaccagaatgtcaggacagtcggcaatagaggaccgacgacattggagaattatgattttttggagaaaatcagccactttgaccgcgaacggattcccgagcgcgtcgttcacgcgcgcggcgccggcgcacacggatactttgaggcgtacggaagttttggagacgaggagatttctaaatatacaagagcgaaagtgtttcaaaagaaaggaacgaaaactccggcgtttgtgcggttctctaccgtcaaccacgggaagcattccccggaaacattgcgtgatccccggggttttgccgttaagctttataccgaagacggcaactgggatctggtcggcaacaacctgaaaatcttttttatccgtgatccgctgaagttcccggatcttgtgcacgcatttcagcctgatcccgttacgaacattcaggacggcgagcgtattttcgacttcatttcccaatcaccggaagcgactcatatgatcactttcttgttttcgccgtggggcatcccggccaactaccggcagatgcagggctcaggcgtccatgcctacaaatgggtcaatgaagaaggaaaagccgtgctcgtcaaatatcactttgaaccgaaacagggcatacgcaacctgacacagaaggaagcggaagagattcaggggaaaaactttaaccatgcgacacaggatttgtatgaggcgattgaaaaaggcgattaccctgaatgggaagtgtatgcgcaaatcatgactgatgacgagcatcccgagctggattttgatccgcttgatccgaccaagctgtggtataaagacgatttcccttggaagccgatcggcaaattggttctgaacaaaaacccggaaaactaccatgccgaggtggaacaagcatcattcggaacgggcgtgcttgtggacggccttgatttttcagatgacaaattacttcagggacggacattcgcctattcagatacccagcggtaccgcgtcggcgcaaattacctgcagctcccgatcaactcgccgaaaaagcatgtcgccaccaaccaggaaggcgggcaaatgcagtatcgggtcgatcgggcagaaggacaaaacccgcacgtcaactatgagccgtccattatgggaggactcaccgaagcaaagcaggatgggaaagaccatatacctcatgtcgaaggcgatgtgaagcgggaagcgatcgaccggccgaataacttcggccaggccggtgaaacataccgcagattttcggaatttgaacggaccgaattgatcacaaacctggtcaatacgctttcttcctgccggaaagacattcaggatcaaatgattgagaatttcacaaaagcagatccggactacggaaaacgtgttgcggaagggctgaaaaaagcctccgaaagcagcagcggcgggccgatcggcactactgatacggcacaagccgcaaaacaggctgaacaggaaagccatccgtctgatccgtattaaataaaaaaacaggacaatcgcgtcctgttttttttttgagctaattcagctcctgtatattctgctccgccgcggccgcaaatactttcggctccggacggtcaagatcttcatggaataaacttactttgtgaatctgccggttgtcgtacagatgaaagtagtagttcccggtgtcacagcacataaccgacgtatactgcgtataatcaatttcattctcctctgtgatcaccgcgccttttggaatattcacattggacagcacgtgaaaagcggccgtaacgccatccgtttcatgagcggcaggctctaaatgctctttcagataagcggctctgatgaaccgggatggcggcgtgtaatcaccgggaagcccgatcgttccagatccttggccgaaagcggttaatgtcattccgcccaatgttttgctttctgactgctgcggcctgattccgatataatggcgcagattggtcacatgccaaggaaattccggactgttggtcatcactccgggtttgttgtcatatactttcattccctccggtgtcggctcgatgacaatgcagccgcccgtgcggtctgataaaatccaatgaagaggcagcaccgtatccaataacattaacttcttctctacaatcgtcagcattgagagcttttcctttatgtcttcaatagattcacagtttgataaggcccaggtgacaaactcatgaggagcaatgtgacaggtgccctcccgttccgctttctcgtatcccgcaaagcccggaaaatacagcgtcgcacacgacagccctttttcatttacgccgtcggcaaacagaacattgccgagatttctccccatgccgataaatgcgtatttcgtcttatgcatcctgccgtcagcttcgcttttccagctgtactgacgagggtaaagcacgacgtccgtaccgagctgaaatgcaaaatccatcgttcgcgccaataggtgattaccgtctgtcgttttcaatgtaagacttgtacacatatcatcaatccccttttcattaatgaaatttacacaaagtaaactattctttcagcttaacgaataatggctccattcgtcaaaagattgacacatttctccttcatacatattagtccgtaagcatatccatgccttttaatccctggcaaatcgtttaggcggcagtgtttgtaccgtttttcaaaaaaactttgaacggctgtcagcgaggctttacaatgtttttcctgcatgctggaatttgtaaacggcaggtcaatctgttaagctatgtctttatgttaaagaagaacatacggaggagattatctattgaaagtagaaaggcgaacgattgaacatattccgcatgacgaaagacacggaaaggctaaagatttattccccgtctggttcggggctaatatgcatattacgacgttagtcacaggcacactgcctgttacaatgggactcgatctcttttggagtatcgccgccattataatcggaacctttatcggcgcaatctttatggcgtctcattccgcacaaggacctcagctcggaattccgcaaatgattcaaagccgcgcgcaattcggcgtgatcggagcgattctgcccctctttttggtcatgtttatctacctgggcttctttgcgagcagtacgattctcgcagccggtacactgagcagctttgtcccgattccggcttcatggtgtattatcggcttaagcgccatctgttttttactcacgatctacggtcatgatctgattcacaaaatgcagaaaatcctctcttggacctcctttgccgttttttttgctgcaacgattcttatttttcaactgccgattccttcaggaagctgggtgcccggctcattagatctgcctgtttttctagtggcggtcagcgcggtggccacatggcagctggcatacgcgccatatgtcgcagattattcccgttatctgccggtcaaaacaccggcatcgcatactttttggtacagctatgcaggtacgtcagtcagttccatctggatgatgcttctcggcgccattttgacgacggcgctcccggaatttaccgctaatgcgggtaatgagattgtccgattgttcggtccgttttcctttattatgctgatcatcgtcctgttcgggcaaatggcgatcaacgtctttaatttatacggagcctttatgtcaaccacgactaccttggagccgtttttaaaactgaaggtgacgccgaaaacgagagtggtaatgatcctttgtgtgacggcagcgggtactgtattaagtctcttgggccaaagcaatttcatggaactgtttttaaatttcatctttttcatcagttatttcttaattccatggacggcgatcaacctcgtggattactattttatccgccgcggaaaataccacgtcaaatcgatgtttgacgtcaacggacaatacggcagggtcaattggattacagcggccgccttcgttttgtcgattatattagaaatcccgttcatcaatacatccttttacatcgggccgctcgctgaaatattcggcggaggcgacattgcctgggtcatcggcctggccgttccgtcgctgctgtattatgtcctgatgaaatcaaggttaaaacaaaaagaggcgccttccctatgaagacgccttttctttattcatattccttccatacacgcggcagcagttcagaaagttcgtgcgccaataaggtatgggcggagcgctctttcgtccataattccgcacattcgccgtgaaggcggacggcgttcaatacggcgtgcttcgggtcttgatgacagcacagcatgccgagaatcattcccgtcagcgtgtcgccggtcccgccttttgcaagcgcgccgtttccggttgtattcctgcggcattccccgtcgggaaaagcgataatggtttcgtttcctttcaggacaatcgtgacatgaagccgctccgcccattccgcggcatattccgctctgttctgctgaatctcttgaatcggaaggcctgtcattctggaaaattcgccgggatgaggcgtcaagatcacgggagctttcctcttcggataggttcttttcgtaatggcgcccgcatccagtatgacgggataatcgccagaaagcagctgatcagccgcctgctgcacttcgtctgtttggggaaggcccggcccgatggcagcggcccggatggtttccccgggctggcccgccgcggcttttttccacccatcccgccagtacgtggcttccggcagcaccgggacgataagcggaatgacgcctgccgatgtaccgatgacgagcttgccgacaccgcttctcatcgcacccaatccggccagaagggcggctcccggcatgtcatcgctcccggccagcaataacgccttcccgaacgtgcctttatggctgtccgcctcccgtttcggcagcgtatctttcacatcctgttccgtccaatccattatattcatctctgtacctcctcttctgtctcctatttatattccaaacaagaagagattttaaaccgcacaaaaaaacagccgctcgtttgcggctgtttatgttctgatcggaacatcaagacggtaaagctttcggtaccgttcgttttctgcaagcagctcttgatgggttccttccatttctgcttttccattttctaaaaagacgattttatcagctgtttccacacccgctaaatggtgtgtaatccagaggatcgttttctctttaaaaacatcaaaaatcgtatcaagcaattcacgttcagtgaccgcatcaaggccgaccgtcggttcatcaaggataatgaccggcgtatcttggagcagaatacgggcaagcgcgatccgctgccgttctcctcctgagaaacgaatccccgtctcctgcacggacgtttcatatccgtcaggcagtgattcaatataatcatgcagcttcacttgccgagccgcacgcttaacatcttcatcactcgccttgccgtttccgagccggatattgttcataatgctcgtgttaaagagatgaggtttctgattcaaaacggccaccgctgaggaaatctgctcctgcacggccgcagtttccagcccgttcagcatcaccttgcccgaatcgggaactaaggcgccttcaattaaagcgagagaggtcgacttaccggagccgctcctgccgagcagcgccattttttccccctggcggagagtgaaggaaaaacggtcaagcacatgactgtgctgatcataagaaaacgtcacgttatcaaatgtaagtgtcacatcggatacatccagtatctcatctatctgcttcacctcacgacttcgcagctccggagccgccttactcattcttttgatggaatcctgataagaaggcacttccgtcagcgcatccgaaaggggcagaaacgcctccgtcaatggaaatacgacaagcacaaaggctgcgatcatcgtgttggcgatgctgccgtccgcatactgacccgccgtccagaacagcatgatcaatatgaagccgccgacaaggcattgcgcggcgagatcacgccatctcgtaaaccgctgacgtttgctttcaaggtcaaaccatgccttctctttctcttcataagaggaaataaaggccgcctgtcgtcccgagaacatccagtcgctcacgccgagcacggcatctgtcagccggctgtagagcgtattccggccgcttttcagcctcatgtttttcgctctcgtcacaagaagcgacacaaccggaaacaatacaaccaatataaacaggtaaatcgccgcaaaagcggcaaacggccaggaaaaaaagccgagtccgataacggatgccgcatacagcagcaaagcggaaaccgccgggaaaatcgtttttaaaaacgcatcctgcaaatgctcaatatcctcagccaaaatgccgagcatgtcgcccgtccgaaaacgggataaaagcatgagcgaggccggctccagcatattgtaaagccgcaccctcatatcggacacgattttcaaaatgatatggtgccccgtcaggcgctcggcgtaccgtgagactgaacgggcaatcccgaaggtgcgcacggccacaatcggaacgtacaccagcaggatattctcaggccttgtcgccgacttagagatcaaaaaaccggaagtgaacatgagaaaggccgccgaaaaaatcgtcaccgcgcctaaaaaaatcacaagaacaaacaaacgggcattttgctttatatacggcagaatccattcttcttttctcatgttctttcccccagttgcgcctttacaagtttggcatatacgccttgtttcgccatcaattcgtcgtgggtgccgatttccgccaccgcgccgtcatcaagcacgataatttcgtccatctcaagcatccagtgaagacggtgagtggccagaaagacaagtttgttttcaaacaggtctttcatcgtttcttttatttcatattctgtttcaatatcaaggtgagcggtcggctcatccaaaaggagaatcggccggtttcctaaaaaggctctggccagcgcgacacgctgagcctgccctccgctgagcgcccgtccgccctcgccgatccggccgtcaaggccgccgggcagatcgcggatcagtccggaaagacccgctgaatcagcagcgcgcgccgtttcctcacgggaagcatcaggatgataaaaccggatattattcataagcgtgtcatcaaaaatgtacggatgctgcggaatataaagcagctgcttctgccagccgtctgactgcagatgcgagcgggattcaccgtttaccttgatctcaccggacgcaggctctaaaaagccgcccagcacatcaatgagtgtcgattttcccgcaccgctttccccgataattccgattttcttcttccctttaaaggacagatgaaattcagacatcgattctcggacggacaaacgcgtaagctgtaattcatccccgtcagtccacgtatcaagttcgagcggcttttcttctttaaaaccgggctgcgccaaaatcgcttgaatggttttccccgcctcctgcccgtttaacgtcgcgtggtaatcatttcccacttcgcggaccgggagaaaatattcaggcgcgagaatcagcgctgtcaatgccggaccgagcagaatttgtccgtctatcagccgcaagccgagaaacaccgccactgtcgccaccgacagcatcgtaaagaaatccagggcgaatgatgataaaaacgcgacccggagcgtgctcatcgtcgccttgcggtatctctcactgacatgaaagatgtttttactgtgtgatttgcttaaccctaaaaaccgcaatgtctccagtccgcggagcgaatccacgaaatgattggaaagcgtctgataggacttccattggcgatcggcttttttctgtgcgacaagtccgagcaggatcataaatacaatcaaaatcggaagcgcaagaatcagaatcaaagccgatgttttatcctgaaaaaacacgtaaataacaacggccgccggcacaatcgccatgctgaccattttcggcagaaacagctctaaataacggcggaactggctgatgccttccatcgccagcgtcaccatccggcccgtcccctcttttttcgcaaagcgggggccgagacggaacaattgctcaagaaatctttttcttaagtctgcgccggtttgcgcggcatattggtacacgattttctgccggaccgcggttaccgcatgccggaccaaaaacgcaagcaggaaaaagccgataaccggataaagagaagcaatccgcttcccgttaaataatccggttaccgcctggctcagccattccgcctgcaagatgatggcggccgtttgtataatcgttaatcccgtaatgatcgcaagaatccgcttcattcctttataaagaaacaggtcttttcccattaataagtcataggctccttatggctgacgcgtttccggaagacataataactccagatctgactgccgatgacaaacggcagcagagtcagtgcggcaattgtcatgaccttaagtgaataatcaccggaagacgcgttagctactgttaagtcatacgcgcttttcagcgagctgaccatgacgcgagggaacagagagataaaaattatcgcaactgtcaaagcaagacccgcgccggtcataccgaatgcccagccgtcttttttcttgctcatgaacacaacagcaagaacgttgcagatgacaatcagcacgaataccggaatcgtgatgtttgcccggcgtgtaaacatatccgtatcgtatgcagacatcgcaaagaaagcaagtacaacaagaaagataacaccgattacgcgttttgccatttttctcgcacgctcttgtaaatcaccgatcgtgcgcagtgtgacaaacattaaaccgtgcaggaatgaaagaagggtgacggctgctccgccaagaacggaatacacgtttacaatatctgagaaacccgcatgcatattcatatggccgtcaatcggcatgccgcggaacaagcttgtgaagataaggccgaatacaaacggcgggataaggctgccgaagaaaatcacccagtcccatgttttgacccattttaaatgattcacttttccgcggaattcaaacgccaccccgcggcccattaaagcaagaaggatgatgataaacggaatataatatccgctcagcatcgtcgcataccagttcgggaatgccgcgaagatcgctcccgtacctgtcagcagccatacctcattcgcatcccagaacgggccgatggtgttaatcagcactctgcgttctaattcattatggccaagaaatcgggtcgaaatgccgacaccgaaatcaaaaccttctaaaaagaaaaatccgacaaacaaaactgaaacgagtacaaaccaaagatcatgaagtgaccccatggtagacctcctgactgaacggatccgttgatacaggaacatccttgtgatcatcatggtccgcaccttttttaatttcacgaacgaataggaagacaagcagcgcgcctaaaatcaagtacatgacgccgaaaccgataattgaaaacagcagagatcccgtcgttacgttaggcgaaacggattgtgcggttgtcatttgccccataaccgtccacggctggcggccgatttcagtcataatccatccggcagagttcgcaatgaacgggaatgcgatcagtgcgatcatgccccgtaaataccacttgctcgtatgaagctttttgcggcggttcagaataaagcctgcaatcgcggcaaaaatcataagcgcacccgctcccgccataatgcggaaactccagaacgtcgttttaacaggcgggatataatcgccttttccgtacgttttttcatattctttttgaagtgttttcatccctttcacactgccgctgaacttctggtaagccaagtagctgagtgcgtaaggaattgaaatttctgatgtgtttttttctttattcgtatcaatattcgcaaaagccgtccacgcggcaggatcaccgctgtcatcccaaagcgcttcactggcggccattttcatcggctgcgattccattaaatgctcagcctgcatgtgtccgctgaacgcaacgccgataccggcgatcagaccgacaatcatcgaaagcttgaaagatttatggaagaaaggcacttcttttttcttcaataatttaaatgcgctgacaccagcgataaagaaagcacccgtcgcaagcgctccgaaaatgacgtgagggaattcaacccaaagctgagggtttgtcaaaagcgctccgaagtcattcatttccgcgcggccgtttttaatcgtaaagccgaccggctcctgcatgaatgagtttgccgtcaaaatccagaaagatgacataatcgttccgaaggatacaagccaaatgcaaagcaaatgcacttttttagataaacggtcccagccgaaaatccataatccgataaaaatagactccataaaaaacgccaaaagcgcttcaatcgctagcggagccccaaatacgtcccctacaaaacgggaataatcagaccagttcaatccgaactggaattcctgaagaatccctgtgacgacgccgacagcaaagttaattaaaaagagatgcccccaaaatttagccattttgagataggtctcttgttttttgacaacataaagcgtctccatcaaagcaaccataaacacaagcccgatagacataggcacaaacaagaagtgaaacaatgttgtagatgcaaattgaatgcgggctaataccaactcactcatgatgtttttcctccaatctggtaaattgctcaacatttcacaaacatagtgaaatcattgctcggtatttcacaaaaaatgatatatttgctcaatgtttcacaaattcgtcaaaactattgaaatatcagcctgtacaccctgggggacagcggctgtcatagaaatgattcaatatcattactttacaacgattcagcccaaaaaaaaagatcaatatacctaaaatcaggctgaaattgtgactgattattgtcggatttgtagagattttatgtcagcacctaggatatttgtccctttgatatcgtacctcttttttattcgtgtggcgaacaaaatgcttttctcggtgaaaaagcccgccaaatcgccattttgagaaagaaaatgtgaagaaagcatgtcctctagtaaattcataatatatgaacaatttaaattttttagtatactttaaatggggatattttttcactacataacgactgggggaacaagcatgggagaacttcaaccaaaattgcaaacggattcaatccaaaaacaggaacggactgataactggtttgccagagcaatgaatataagaatcggcattattcctcttcctatctatatcctgcttttcttgcttattacggtgtttgtcatgagccgtgatgtaaaaagcgacattctgacatcaattgccgtcatgagttttttcggatttaccttcggccagatcggaaaatccattccgatcgtgcggtccatcggcggccctgcgattctcgcaacctttattccatccgctgtcgtctactaccacctgcttccgaaagacattattacttcaacaacagaattcacggaaagctccaactttctctatctatttattgccggtatcgtcgtcggcagtattctcgggatgaaaagagagacgctcgtcaaagctttcgttaagatttttattccgctgatcgccgggtctatcgcggccgccatcgtcggcttatgcgtcgggacgctgctcgggctcggctttcagcacacgctgctttatatcgtcgttccgattatggcggggggtgtcggtgaaggcgcgattcctttatccatcggctactccgatattatgccgatgtcccagggagacgcctttgcgcttgtgctgccgtccatcatgctcggcagcctgtgcgccattatgttatcgggtttgctgaatgtcatcgggaaacgcaaaccggaatggacgggcaacgggaaggttgataagtctgatcattccgctcccgcattggaacagccggccgatgataaaacgtttgatttgtcctttttcgcttcgggcggtattttagcggtttccctttatttggtcggcatgctggcgcatgatttctttcagcttccggctccagtcgtgatgctcgtccttgccgttctcattaagctgttcaggctggcgccggcttcgattgaaaacggagccttcggcgtctcgcgctttttctcgacagccgtgacctatccgctcttatttgcgatcggcgtttcaatgacaccgtgggacaagctgattgcggcgtttacaatcagcaacatcattaccattttatcaatcgtcgtcacgatgatggccgtcggttttctgaccggaaaatggctgaatctgtacccgattgaaacggcggttattaatgcctgccattccggccagggcggcaccggcgacgtcgcgatcttgagcgccgctgaacggcttgagcttatgccgttcgcccaagtgtcgaccagaatcggcggagcgattaccgtgagcgtcacccttctgctgcttcatcaattctattaaactgaaaaaaagcctccgcatatgcggaggcttttttatttcatcacattttgaatataagagccgaatgccgcgccggacatgcccggcgacacacggacgcggtgaagcccgtaaagcccctgatctctagacgccgctcccggctctgtcgtgaccgccatacggtagcctgacgaggcggcggctttaaatgtttctttattatatcgtccgacagggtagctgatcatagacgtccgctgcccgaacatttgatcaaataaacgcttagagtccttcatttcacgtcgctgctgctgcggtgtgagcccgttcaattcgagatggttcatcgtatggctctgaatggaaatgccgtgggcggccatctccttcatctgcttctcagtcagatgattcttatgcccgataaagtttccgatcataaagattgtcgctttcatcttgtatttctttaaaatgggataggccgctttcacattgtctgtatagccgtcatcaaatgtgatcagaacacatttttcacgcggctccttatcctccgtcagcatcagataggcttcttcaggagtcatcgtataatagccgtgatcatgaagccacttcatatgctgccggaattcttccttcggcacacgcaggctgtttccctctgaaatgctgtgatacatcagaatcggcagtctcgccgtccctttcgtttgaacccaggcggatgtatccggctcttttttgatttgcctctttacggactttttttcgctgtgcgcttctgccttcggaatgctttgttcggcgcttgcctcatggcccgagcaggcggcaagtgtaaacacggcagccaaaaggcacatgcacatgatcatgcgtttcatcgttttcctgctttctgtcttctatttactttttatatcggttatgcgtcataaattgttacatcaaaaaaaccggacatccagctgtccggctttgcattatgagcggattctgatttctgtttcactgtcaaaaaagtgagccttattcatgtcgaaagcgacggtcaattcctcaccggcacgaatgtcatggcgggcatcaatccgggcgataaaatcctgatccccgatccgggaataaaccataatttctgacccgagcaattccgcgacattgattttagctgtgatggatgaattcttataagattctaccacaatcagctcgtcatgtatgtcttccgggcggatgccgaagatgatatctttgccggcataccctttttcccggagcattttcattttcccttccggcacgctgagagcggctgaaccgatctgaatggcgccgtccgtcagctttcctttgaaaaagttcatcgccggagaaccgatgaacccgccgacaaatacgttttcgggatgttcatacacttctttcggggtgccgatctgctgaatttttccgtccttcatgactacgatgcgtgtcgccatcgtcagtgcttctgtttggtcgtgcgtcacatagattgtggttgtttgcagcctttggtggagcttaataatttctgcccgcatctgcacccgaagctttgcgtccagatttgacagcggctcatccattaagaacactttggcgtccctgacaatcgcccgccctaatgcaacccgctgacgctgtccgccggagagcgccttcggtttgcggtgcagatactctgtgagccccagcattttcgccgcttcttcaacccgttttttaatctccggtttcggcatcttcctcagcttcagaccgaatgcgatattatcatagaccgtcatgtgcggatataacgcatagttttgaaacaccatggcgatatccctgtctttaggagcgatgtcattcactctcgtgtcaccgatatagaaatcgcccttcgtaatgtcttccagcccggctaccatccgcaaagttgtcgacttgccgcaccccgacggaccgacaaacacgataaactctttatctttaatatgaaggttaaaatcatcgacagccgcttctttttgatcgtaatacttataaatatgctcgagccgaagttccgccatgtatatccccctttatttgtaaacgctttcttaaataggattgtaacagcgtcagacggcggcggatataggcaatgttcataaaaaaagtccgctgccttcgtgcacatttcccatttaatgtgatttttcatattgcagacaaatgaaataagccagcagggcgccccgatatgtcttaatatcaatacctgagcgttccgcaaatttatcaatccgatattgaagactgttgcggtgcaaatgcagttttttcgatgtgagcgacatgttcgagttatgttcaataaaagtctgaatcgtatgcttcagctccggttctttctgaaacagcagcgccgcttcttcgtgaagcaaggctgagagcttttctctgctttcctccgtgagcatggccggaaataccgtttccgcggtcagcgtgctcagctgcgggagatgacgccggccgatctgacaatattgctgttctctctgataatgaaggcgcagacgttcccccttgcagtaataccttccgacgaaaaaacggacactgaaataaaaatcgccttcgagaatcttcacaaaagatgcgatgtcatccgaatctggcgcttccagcttttcttcctccacaatcacgccatgatccctccccgtccggacaactgtatatgaaaccggccagaaatggcgcagcgcttctgtgaatgccccccagtcccgttctcccaataagtcataatggataaaacggacacgcggctccttgacatcaggcaccggaccttcttccagcagaaaacgccgccacctctttgctgccgccgtctccggaaaaaaaacgcctttttcttcagcgggcgtcaaaaatgattccagaagcagtttctccttcggggtgatatcctccttcggaatggcgacatagacccgccttttctcatcataaaagcaaaagacatcctccgccgtacagcacgtatcagacaacacagccctcgggtaaattgccaataacgggttcatatgcgctcctttctatcgctctatcatattttcagtataaaacgtccggccgattgtatccacttcgttttaagaaacagctttcaggctatttcccgggaaacgaatcataaccgcttctgccggcataagaaaaaaaccctccgcgccggcagagggatcctttttatttagagatatcgacgaagccttcaccaaagacatcacgcacatcatgaacaatgacaaacgcttttgtatcacagcttttaataatttttttgagcatggaaagctcttgtttctggatgacgatatataaaatttccttcgactgccccgtgtaatttcctttacccgacagcagcgtaacccctctgtccatcagcgtgttgacctgttcagcgatttcgtgcttatgctcagatataattgtcaccgcttttttcgtattcaggccttcaatgataaagtccatcaccttcgttccgatgtacagcataacaatggtaaacatcattttttccgcaccgatgatgaaataagaactgaagacgacaatcagatcaaagaacaaaagcgcatagctgatattccaatcgagatatttgttcgcaatcctcgccaaaatggcagaacccgcagtcgtgccaccgactcgaataatgatcccgattccgacaccggcaaacacacccgcaaaaatagtattaataatgagttcatgtgaaggcgagtgccaatcatgcgtcagatgcagaaacagtgagttggcgacaacggtaatgatcgtataaagcgttgtttttccgtctaaaaatttatatccgataatcaataaaatcccgttcaaaatgatattcgtcaccccgggcgaccattcaaacacatagtacaagatcagggtgattcccgttaccccgccctctccaagatcattcggaatggcgaataaattaacggccaaagcaaagataaaagctccaataatcagcatcagcacatccagcaatctctttttcatcccagacactcccttttttataaaatcaaaaaagcccgggagagcactcttcattaaaagagcagaaactcccgggcttttatcccaacgtgtcacagcaggaacctgctgtgtgttttctctcggtccagaccaattcagcattgcggaaccctagaaaaccactgttttttatgttcagtttttatattatctttcaagattatacgggaaatcatgaacatgttcaaccactcttttttcaataaacctatggaaaatgcgaacgatctgccgatactaaaaaggaccttaaaatacatgactaaaaaatcattaaaatactttttttctcaaaatattattgactataggttattttacaggcattatagtatgtagtttttaagaaatagtttacataggaggaaatattatggcagtcaacctggtgtcttgtaaggcatgcggcaaagaaatcgctaaaggcgttaaaaaatgtccaaactgcggtaaagatcagagaaactttttcatgagacataaaatcatcacattgcttctggcagtggtggttattatcattctcgtaaacatcggcggcggaggcggttcttcgtcatctaaaactgcgtcttcaaaagctgcggaatctaaagaaaaactgtataacatcggtgacactgttaagactgagaaaactgaagttactgttacgaaagtggaaaaaagagattcagtaggctctcaatttgtcgagaaaaaagcgtctgacggcggcgttatcgtagctgttcaatacacggttaaaaatgtttcaaacaagccgttaagctctttctccattccaagagcgaaattagtagattctaaaggaacatcttatgattcagatattgatgcttcttcaagctatgcaacagaaacaaaagtagacaacagtaaaattttaagtgacttgaacccgaacattaaagtgactgacgtaaaagcttttgaagtggataaaaacgcatactctaaaggcacttggaaattaaagttcagcaacgatgttgaagtgaaaattaaataatcatcataacaaaagagaccctcatcatttgaaggtctctttctttttacaccttttggtacccgttcacattggaggactgccacttccaagagtcggcgcacatttcttcaagcccgcgctttgcttcccagcctaattcagccttcgcttttgccgggtctgcgaagcatgcggcgatgtctcccgggcgccggtcggcaaaacggtacggcacttcttttcctgatactttttcaaacgccttgaccatctccagaacgctgtagcctcttcctgtgccgagattataggcgtcggcgcccgttgtgttcagcaccttttcgagcgctttgacatggccctcggcaaggtcaacgacatggatgtaatcccgcacgccggtgccgtcctttgtcggataatcattgccgaacacctgcaatcgctcaagcttgcccacagcgacttgtgcgacgtacggcattaaattattcgggatgccgttcgggtcttctccgatccggccgctcgggtgcgcgccgaacggattaaagtagcggagcagcgcaatgctccattcagagtccgcattatgcagatcgcgtaaaatctgttccagcatcagctttgtctgcccgtaaggattggtggcgcttaaaggaaaatcctcagtgatcggcgttgtttccggaacgccgtaaaccgtcgctgaagaactgaagacgatttttttcataccgtgtgcctgcatggcttcacataaaataaacgttcccgtcagattattatgataataacggagcggaacagccacagactcaccgacggcttttaatcccgcaaaatgaatgacggcttcaatctcattttcagcaaacacccggtgaacggcgtcacggtcaaggagatccgcttcataaaacacaagcccttttccggtaatgtctttcacacgctccaatgcttccggtgaactgtttgacagattatccagaaccacgatgtcatagccgccgtttaacagctcgacacatgtgtggcttccgatataacccgctccgcctgtcactaaaatcgccatgaagaaagcctcccctattgaatgaattgaccatattatatcggttttttcttcctcaatcatccatttccaaaaagtttaatcgtttagtcatcgtttcttcataatttattttcattcgcgtaaaaaacagagccctcgattcaaacggggtgtgaaatagaaatccctcccccgcgcatggtaagataagacaaaggagatgacggtatgaaaaatgaaatcattgaacgctttacctcttacgtaaaagtcgatacacagtctgacgaaaacaatgaaaactgcccttcaacccccggccagctgacattagccaacatgctggcagatgaattaaagtcgatcggcatgacagaaattacagtcgatgacaacgggtacgtcatggcgactctgccggcgaatacggataaagacgtgccgactgtcggttttctggctcacgtggataccgcgaccgattttaccggaaaaaatgtgaatcctcagattattgaaagctacgacgggcatgatatcgttctgaatgacaaactcaatgtcgtcctgtcgcctgagcaattcccggaactttcccgctataaaggccagacgctgattacaacagacggcacgacgctgctcggagccgacaacaaagcgggcattgccgagatcatgacggcaatggcgtacttgatcaaacatccggacatcaagcacggaacgatccgggtcgcgttcacgcctgatgaagaaatcggcagaggccctcacaaattcgatgtcggccgcttcaacgccgcgttcgcctacacgatagacggaggccccctcggcgaactgcaatatgaaagctttaacgcagccgccgcaaagcttacttgttacggaaaaagcgtccacccgggaacggcgaaaaacaaaatggtcaacgcttcaaaaatcgcgatggaatttcatcacgcgctgccgaaagaagaagcgccggaatatacggaagggtatgaaggcttctatcatttactttccatggacggagacgtttctgaagccgccctgtcatacatcatcagagattttgacagagaccgctttgcagaacgaaaagaatatatgcagaaaaccgccgatgcgctggcggccaaatacggcaaggaaagcatcaagcttgaactgcgtgatcaatattacaacatgagagaaaaaatcgaaccggtcaaagagatagtcgatgtcgcgtatcaagccatgaaaaacctcgacatcgaaccgattatcgaaccgatccggggcggaaccgacggctcacagctctcttacatgggactgccgacaccgaacattttcacgggcggccaaaacttccacggaaaatatgaatacatttccgtcgatcatatggaaaaggcggtaaacgtcattgttgaaatcgccaggctctttgaagagcgcgcttaaaaccaaagccccctgctttggtttttttctttcacatgaaacctttccttctttctttccgtatataaggtatgaaatggaaagaaggagtgaagactatggcaagagggactgtagcgaaagaattgaaaaaaaccttaaaagacccgcgtgtactggagacaaaatcaaacccttttaaaaaactgcggaaaatgttcaaacgatttttttaagataacatctcgttttctttaaaaaaataaagaaagcgctgtcaactcgcagtcatctgttagaagcagttattttgcatatcataaggttttttagggtactgaataacacaaagcaaacgaaaacaccgaagtagttaattagacacttacaaaaaatagtaaaaaagttatataaacgatcatcattcatcagccgatacaatctatagaaccacaacaagagcaaaatttcttcaacccatagttatttttacggaaaatgacgttattttttaaaaaagtgacaattgtttgaatacttttcgtttgttttttcgtacaataataataccaaaactttttttgggaggtatgtaaaatgatgctacttattttcgctgctttgacagggtatcttgttttctctttcagtaaggacaaccgccggaaaacgccaaagacaagcccgctggtgacagctgccgacacgaataacatcattgatttaaatgcgatccgtcaaaaacgccggatgccgctatcataaaaacgacagctgccgcaaaatcggcagcctttttttatgcacccggccgatatgaaaccttccgcctccttttttcgtacaacataaaaaaggagtttttttatgtaccatttttacatcaaagagcgaatgtttacgtttaagaatcgttttcaagtgtttcttgaaagcggaaaagaagtctacaatgttgaaggaaagctgttttcattcggtgatgaactgaagctgactgatttggacggccgcacgctcgccagcgtcaatcagaaactgatgtcgctcgttccccgttacgagatttccgtcagcggcaaacccgtctgccaagtcatcaagaaagtcacgtttttcaaaccgaaatttgaaatttccggactcggctgggatcttaccggcgatgtgtggggccggaattttcaagtgacagacggaaaatcaaaccggatgaccgtcaccaaatcatggatgagctggggcgattcctatcatttgcagattgaaaaggaagaggatattgctctttgtcttgccatcgccatcgtgatagatatgattctatttgagggtgacaaataaaaatatttatcgaaatatattgacaatatgagaaaacatactaagattaagagtattacagtttattctgaaaaatagcatatttccttatcaagagaggtggagggactggccctatgatacccggcaaccgctgttcagcagaatggtgctaaatcctgaagataaggttgagatttgcggacgcaagctcttccctatccgagggaagagtttttttatatttcatcaggaaagaaggaatcgttcatgtcacagcaaaacacagaacaaccattgcatactcttctaagaaaaaacccgccgtttcgcgcggatcaggtcggaagtctgctgcggccggcggctgtgaagcaagcccgcctgcaaagagcggcgggtgagatttcggcagaacagctgcgcgaaatcgaaaacagagaaatcatccgcagcgtggaaaagcagaaagaaaccggcctcaatgtcgtgactgacggcgaattccgccgtgcctggtggcattttgattttctcgaaaatttagacggggttgaggcatttacgcctgaaagcggcattcagtttcacaacgtacagacgaaagcgcgcggcattaaagtaacgggagatattgatttttctcagcatccgatgctcgaagattataaattcctgcacagcattgccggcgatgctgttccgaaaatgaccatcccaagtccgaatatgctgtttttccgcggaaaattggaaaaagcggcctaccagaatgattacaaacaatttcagcacgatgtgtcaaaagcgtataaaaaagcgattcaggctttttatgacgccgggtgccgctaccttcagcttgatgacaccgcatgggccgttttcttatctgaagcggggcttcgtcagattgaagatttcggcacaacgccggatgagctgcgcaagctgtttgccgcttccattaatgacgcgatcaaggaccgccctgacgatctgaaggttacgatgcatatctgccgcggcaacttccaatccacatggacggctgaaggcggctatgatgcagcggctgaaacgatttttgacgggcttgaccttgacggattgttcctggaatatgatgattcccgctccggcggctttgaaccgctccgctatgtcaaacgctctgatcttcagcttgtgcttggattgattacatcaaaacatggcgaacttgaagacaaggacgcgattaaacgccggattgaagaagcttcacaatatgtcagcctggatcagctttgcctcagcccgcaatgcggattcgcctccactgaggaaggaaacctgatcacagaagaacagcaatgggcgaaactgcgccatgtcgtcagcattgccggtgaagtctggaaataaaaaaagacacgcgatcagcgtgtcttttctgtttacagaggaccggttccgattaaaatatcgatatctatcgtaatatccgccgcttttcggctgataaaccgccggatgctttcatcagtacatttccatgttaagggcgtcattttcacaagccgctcgaggtcaggctgcgataaggtcttcgtgtaacacagccgtttgcgctcaaaggtttgaaagcccgcttggaatcgtccggccgcagaatcggcggtgtcattccgccgaggactgtctccgaagaagaattcccttacttccttcaaataatcacgccgcggcaccgctttaatgactgtgccgccctttcgtaaaagcctgctgcattccttgtaattccaaggtgataaaacagacatcacgacatcaaaacagctgtcggcaaacggcgcatccgccacatcagcgacggcaaaaaccaaatgatccccgaaggcctttgcggcatgcagcacaccttctttcgagagatcaatgccgattcccgtcacggaaaaagcgggctgaagccatttgcatacggcggctaaatgagtaccttctccgcatcccgcatccaatatcgccgccgttgtttgcggagattgaatgcggctgatgatggcggcgatctccttttgaaccgggacaaaaaattcccggctgtcaaaaagagcgcgtctcgcttcgaacagccgcctgtcatagcgggttttgaccgatttattgaggaaattcacatatccttgctttgatatatcaaatgtatgcccgtgtccgcacatcaagcttttgtattgtgaaaccgccatggccgaactgcatagcggacacctgaatacggactggcatgattgcagtaattccgcgcgttttctttttatagacgtcaataaaaacacctcattcattcgttattccgatgaaatgaaaaaggcatagacaaataaacctcgcaaaattggaagtttaacctatttatctatacctctcattatctgtaacgaatgaactgaatgatcatgaaaatgaccccttttctgccgtcttttgaaggcggtgccctcagatccattttatcagctgcatcccgtctttacaatgaaccggaactgtttttcgggggcttttatacctttattatccaattacttgtgaacatcctttattttctttatttataatataaatttattattttgaaaatatctaaaaaggttgattttcaaaaattgaaacgataaaatactgctatctcatgtaatatcgttattcttgtatatgatcagtaatatggtctgattgtttctacctagtgccgtaaaagactagactacaagaaagtttgcataaatttgaacgagtgaaaagcatatgatgctgtcagtctattcttttcttttggctcttatttatcacactttctggctttcaggaatttgtgacgaataagagctttttttatttccataatacccttataggagttgctcacatgtactttttattgaacattgtcggtctcattgttgtcatggctgttgttttcttatgctcacccaacaagaagaagattaaatggcgtccgattgtcatgctcctcgtccttgagtttctgattacttggtttatgttagggacaaaagtcggcggctttgtcatcgggaagatcggcgcgttctttacatggctgatttcctgcgccagtcaagggattgccttcgcctttccgtctgtcatggcgaacccgacggttgattttttcttcagcgcattgctgccgattatcttcgtcgtgaccttctttgatatgctgtcgtatttcggtattctgccgtggctcattgataaaatcggctggctgatttctaaaatatcccgtctgccgaagctggagagctttttctccatccagatgatgtttttaggaaatacggaagctttagccgtcatccgccagcagcttgccgccgtcagcaacaatcggcttctgacattcgggctgatgagcatgagcagcatcagcggttcgatcatcggatcgtacttgacgatggttccgtccacttatgtgtttacagccatcccgctgaattgcttaaacgcgcttttaatcgccaatatgctgaatcccgtggacgtttctaaagaggatgatattatttacgttccttcaaaagcggagaaaaaagacttcttctccacgatttctaacagtatgcttgtcggcatgaacatggtcattgttattttagcgatggtaatcggatatgtggcgttaacggctgcgttaaacggcgtactcggactgttcatgcacggtttgaccattcaaaagattttctcatacatcttcagtccgtttgccttccttctcggattaggcgtacatgacgcgatgtatgtcgcacagctgatgggcatcaagctcgcgacgaatgaatttgtggcaatggccgatctgaaagggcagctgaaatcacttccgccgcacacgattgccgtggctacgacattcctgacatcatttgcaaacttcagcaccatcggtatgatctacggatcttatcaatctctgcttgatggtgaaaaatcagccatcatcgggaaaaacgtctggaagctgcttgtcagcggaattgccgtttccttattgagcgcggcgattgtcggattgtttgtctggtaaaagaaaaaaaagcgataccgctccgttttggagtgatatcgcttttttttattgatagacggatgcaggcacgaaaacgtcccggattcctgccgcgtacggtccgagatcatattgtccgaacacaacggcaatgccgtttttcgtaaagaagaaaggtctttcgttattgaggatgatctcttgttttttgacgtcctggtcaaacagatcgttatgtttcttaatgtagccgtaaagatagtctctcgttttgttggctttcgtttttgtattcagcacatcattgagtgtgacccgtttttttgcggccaggtcgtaattaaaggtctgaacggctgtcagcccgtgtgcgccgcctgtgtaactgtagttttccgtctgaatgctgagtttgccgccttgattatacttcaccttgaaatctgcctggtattccgctttgtagccttgtttttcaccatcttttttgttttttacatattctttgtacgagttttcaatatagcgtttgaagtcctgattgattttcttttcaaaagatgcatttcccgtatttgtgacctcggggtacgtcagctgctttacatgcttatacgtctggcttttgacgacgggctttgcggtttgcgcggcctcggctgaaggcgcgaaacctccgaacggcgcggctgtcagcacggttaagagcacggccgccatcattttgaatgcttttttcatcacaactcctccttttcattaccgttccctttttgaaaacggtttacactctatagacagcgcagatcagcaaattgtttctgggccttctttcacattttctccatgaaaaaagagacatggataatccacgcctcttttaccgtgaaggtctttgcgcaatggcttcataaacggcttccgccaaatcggagttgccgaacatctccaaaacgccgatgacggtttgatcaggaatcggttctgattcctccttcggcacgacaagctcttcagccgtttttcgcagctcttcgtttaaaggctgtccggggtaagccttgctgtaaatggccatcggatcaaggtcatgattgacgcaccattgggcaaacaccaaaatcatcatgttttcgtcacgccggtaatattcttcgagttgtttttcggtaaacggcttcactatcaatcgctcctccagaaaatctacccctaagatacacaaacacagagcggaagtaaaccaaagagggtgaaacatattatttcatcaacccgcctgctttaaataatgcaatgccctgactgtcccggacagcggaaggtacggatttgcacggaagcaatttcgttttctcccaatattctttcacaagaaaaaagcgcccctctcataaaaaggcgctttttcattcttatatgtttctgtcccaatgccgatgctcagccacggctttcagaaattgttcatggtttccgtccggaacaagaccggggccgctttcggttccggcggcgagggcgagaagttcttttccttcaccggaggcgccgatcgctttgtaatggctgaaagcttcgttgacgaagtctctggccgatttttgggctttgaggctgtctgtgctttgttttccgcccggaatgaaaacagcgtcgtacaggacggaatccgctgtcaggaacgtggctgacgcttcgagctccgtgccgttttctcccttaacggttccaagcacaggactgatgatatcggctctgactcccgcctgtttgcatgcgtcaagcacttgtttgactttctcatcagaaaacccgtggtcggttaaaaccgcaacctgccttgtcgctgccgtcttcaccgtgttttcctggcttaaggccggggaagtgaacgtttcatcagattcacggtccttcggcggcgggttcacgccgattcctttcgcaacacgctcggcaagcccggcgtcgacgtgactgaagacatcaaccacctgctgctgcacatccttgctgttcacttttccgacttcaaaacagaacgcggagatgatatgttctttctcggcgggagacatgctgttccagaacatcttggcctgagaaaaatagtcattgaagctctcactgcgctggcggatttttctgccttctactttttcctggtaatgaacgtatccgccttcttcttctgaggccggcgacggatcattgttctgcagggaatttttatgataggcgacagggcccttattaatcgtcatccggtggtagccgtcgtattggttgttatggaacgggcagaccggccgattgatcggaatctcgtgaaaattcggcccgccaagacggatgagctgtgtatctgtataagagaaaagccggccttgaagaagcggatcattggtgaaatcaatgcccggcacgacatttcccgggtgaaaggcgacctgttccgtttccgcaaagacattgtcctgattgcggtcgagggtcatttttccgatcagcttgacgggaaccaactcctccggccacagcttcgtcggatcaaggatatcgaaatcaaatttaaattcatcttcttcgtcaatcatctgaacaccgagctcatactcgactttgccgccgttttcaatcgtttcccacaggtcgcggcggttgaaatcgggatctttcccggcaattttctgcgcttcatcccatacgagggaatgaacgccgagcacgggtttccagtggaatttgacaaagcgcgcttttcctttctcgttgacgaaacggaacgtatgcacaccgaagccctccatcatccgatagcttcgcgggatgccgcggtcagacatcgtccacatgaccatgtgcgcggattcaggattgtttgcgacaaaatcccagaacgtatcatgagccgtcgcagcctgcggcatttcattgtgcggttccggttttatggcgtgaacgagatccgggaatttgatcgcgtcctgaatgaagaacaccggaatattgtttccgacgaggtcatagttcccttcttcagtataaaacttcgtcgcaaatcccctggcgtcacggacggtgtcagctgaccccttggagcccgccactgttgagaaacggacgaaaacaggtgttttgacagacgggtcctgcaaaaatttcgcccgtgtatattccgtcatcggttcgtacacctgaaaatgcccatgaacgccgtacccgcgtgcatgaacaacccgttccggaatccgctcgtggtcaaagtgcgtcattttttcacgaaaatgaaaatcctccatcagcgtggggccgcggacgcccgcttttaaagaatgctcatcctcagacacgcgaagcccctgattggtcgtcatttttttgccgctgttatcagatcggtactgctccaactgttcgtcctttgagtgttcatttactcgtttgttttgatcatcactcatgtcagttcccccttctaaaacgaaacattctacagcacatttacccgcggcgttctttaaataaactgctgatccgctcattaggattttaggtctgtatttacatatgcggtcatacacattttgaaataagccattttcacagaaacaaaaagtgaaagcgcttaccaaaacagctgttgaacaggggaggtcatatcatgcttgccatactcggttttgtgatgatgattgtttttatgtaccttattatgtctaaccggctttccgcacttattgctttgattgtcgttcctgttgtgtttgccctgatcagcggatttggcaaagatcttggcgggatgatgattcagggtgttacagacctcgctcctaccgggattatgctgttattcgccatcctgtatttcggcattatgatcgactcaggcctgtttgatcctctcattgccaaaatcttatcgtttgtcaaaggagacccgttaaaaatcgccgtaggcacagcggttctgacgatgaccatttcgctggacggagatgggacaacaacgtatatgattacgattgcggcaatgctgcccctttacaaacggctcggcatgaaccgtttggtgctggcggggattgcgatgctcggttcgggcgtcatgaatattattccgtggggcggaccgacggcgagggttttggcttccttgaaattggacacgtcagaagtttttacgccgctgattcccgctatgatcgccggcgttctctgggtgatcgccgttgcttatctccttggaaaaaaagaacggaagcgtctcggcatcatttcgattgaacacgcgccgtcttctgatccggaggcggcgccgctgaagcgtcccgctctccagtggtttaacctgctgctgactgtcgctctgatggccgcgctgatcaccagcctgcttcccatccctgttctttttatgatcgcgttcgccatcgccttgatgatcaactatccaaatgtcgaagagcagcagaaacggatttcggcgcatgcgggtaatgcgttaaacgttgtctcaatggtgtttgcggcaggcatatttacaggcattctctcaggcacaaaaatggtcgatgcgatggcgcattctctcgtttccctcatccctgatgccatgggtccgcatctgccgttgatcacggcgattgccagcatgcctttcacctttttcatgtcgaatgacgccttttacttcggtgtccttcccatcatcgccgaagccgcttccgcttacggaatagatgccgctgaaatcggaagggcctccttgctggggcagcctgtgcatctgctcagcccgcttgtgccttccacctatctattggtcggaatggcaggcgtcagctttggcgaccatcaaaaattcactattaaatgggccgtgggaacaacgattgtaatgaccattgcggcgcttttgattgggattatttcgttttaattaaaaaaggatttccgctggcggaaatccttttctgtacattatttttttgtatagcgcacccagtcataatgagcgtatagcggatttacaccattgtaggaaccgagccagtcatcgacacctatcccattccacaagttcatcatgatctttcccggtgttgtcgggatttggcttgtcgcagtatgttttaattgcccatcgacataccattttatagagttcggctgccaatcgaacgcatacgtatgataggcattggccgcgtcaaatccgagatccgcaaccttctcatggtttcccgcgccatttgtataataattaaattgaacctttgtcgtgtcttttcctaaaaattcgatatcaatctcatcccaaggggtaccatccgttggacctgtataagtgaagaacgatgaaacgatccccgtgtttttagccggtttcattctgacttcataaagtccatagccataggtttgagcggagcggttctccccgcagtcaaacttgttataagacgggcttgtcagcgccaaacgcatttcacctgatgacgtcacggatacattatttgcacgccaagtgcagttgaacatatctccattggagtaaccatttgctttttgccagaaaccggagttatagctgttaaaaggttcaaaaaacgatccgcctgtttgagctgatgcagcagaagtgatcgcacacaaactcaaaaacaatccagtgacaagaatgagcagcactcgtttcatacgataaaacatgtcggcattcccctttctttgagagcgatttctttatcgatcatacatgattctgttaaaagggaacatcggtcagaataatgataataacgaatcttaaaaaaacctaaattaccatcagcacaaacagaaatgatccgcgctcattgtaatttaggttttgcatgcttatcagcaacaatcctaacaagatcatatgtgaatgtaagaaaaaatgaatccaagaacaataatgccaacgctttcattatgcttgtttgactaccctttctatgtgaatcgttaaatacagcagctcgtcactggtgagcttgtgctcatacgccctctcaatgcaagtttggattttcttcgtgcattcatacgcccggcggtatttttctccagcaaaaagtcgatgtgtgccgttaaaaagacgctgcgcgaaaaactttaagtgggtgacaaaccgataatagtgaagcgattcttcgttgaattcaatcttaaaatggtattttacgatactcaaaatctcttgcatgacttttgtaatgctgatgatattgggcatctcctcattcagctcggcatttacaatatgcagcgcaataaaacctgcttcatcctccggcagagacacgccagtcttgttttttaccatgatcagcgattcttttccgattgcaaattcgtctttgtagagccgcttcgtttcccacagcaaggcgtttttgatatccagccctttcttattgcgctgaatggcaaagttaatatggtcggtcagcgacacatagatgctgtcgttgagctttttgccaagctgtaatttcgcatagctgataatctcctcggatacttccatacactcgatcggaatatcatacaaaagggttttgaacttcggatacatctttgttatcgagggtgagcactttctcaatgcgggattcatctgccggatctcccgttttcttttgaaaagcaatgccccggcccattatgaccaattcctgattgccttctttgagcacactgacgacattatattaatgactttcgcaatcttcaattccgtctccctcccgcctgaccatttacctgctacaccttgattgtacatcctttttgtaccaggtcaatatctccaggtcaatcagaaaacgccgttcagaaatcattgtccaacgatgaggcagaggcgcatataatgcagagaaccggtttttgggaaggagcgtgtgtgatgaaacggttttcgaaagaagaaagcagctggatgctgtatgattgggccaattcagcttattcggtcattattatgacggcggtgttccccttgttttttaaagcggcggcggcggaaaacggcgtcagcgcagctgattccaccgcttatttgggctatacgattgccgccgcgacttttattttggcgatgctcagccccgtcttaggaacgattgccgactacaaaggatgcaagaaacggttttttgccttcttttttctgatcggtgtggcgggcaccgccgcgctggctttgattcccggcgaatcttggatgctgttattaatttgttatacgatttccacgatcggctttgccggatctaatgtgttttatgatgcgtttctcgttgatgtggccgcaaaggagcggatgaatatggtgtccgccagggggtttgggctgggctatatcggcagtacaatcccttttctcctgagcattgccgtgattctgtcagcacaagcggaggtgattccgctgtccgcccagactgcgggccgcattgcctttttaattacggcggcatggtggggactgttttcgattccgctccttctccgcgtccgccagcgctattatatcgagagggagccgcggcttgtgatcagcagttttatacggctggccggcacgctgaagcagatcaggaagcaccgggcgctgtttttgtttctgctcgcctatttcttctacatcgacggggtcggcaccatcattacgatgtccacgtcatacggggctgacctcggtatcagcgcggcaaatctgctgattgttttatttgtcactcaggtcgtcgccgcccctttttcaattttgtacgggcggctggccgaacggtttaagggaaaaacaatgctttatgccggcatcggcgtgtatatgattgtctgcacgtatgcttattttatggattccgcttttgatttctgggttttggctatgcttgtcgccacttcccaaggcggtattcaggcgctgagccgctcttactttgcaaagcttgtccccaaacagcacgccaatgagtttttcggcttttataatattttcggcaagttcgcttcgattatcggcccgcttttaattgccgtcaccgcccagctgaccggaaattcgtcagccgccgtgttcagcctgattttgttatttgtgatcggcattgccatccttgcgtttgtgcctgaggaaacggcgtaaaaaaagcctgcgcgcggcaggctttctattttatttcttggctttatggactttcagttttttgcctttgaccgtcgtatttttcatgatgtcaagaacgtgcgggccttttccgttcagaatttcgacgtacgatgcgttgtccagaatcgtgataatcccgatatcatcggctgaaacgccgtcgattttcgcgatcgtcccgacaaaatcgaccgctctgagttttttctttttcccgccgttaaagtacagcttcatgatgtctttgtttaactgttcgcttttgtctgttttgacatcggggcgggcgttcagtttttccgaaaaagccgctttccgttccgctgtttctttttccgacggcgcctcccgcttttggatgcggaaaccgatatatgtctcaatgtcatgcagaaaacgcgattcagaaggcgtcacaaacgtaacggccagtccgcggtgtccggcgcgccccgttcggccggtgcggtgcacatagctttctttttcaagcggaatatcataattgatgacgaggctgatgttttcaatatcaattcctctggcggcaacatcggtcgcaatgagatagcggaactcgccgcgtttgaattcattcatgacgtcaaagcggtcttcctgcaccatgccgccgtgaattttatcacaagggtagcccagcctgtccagctcatcggttaactggatgaccctttcttttgtccggcagaatatgatgcagctgtccgggttttcggtgatcaggacatcacgcagcaaagatgatttatcctcttcttctgttctggtgacaaaatgctcaatgtcttttgtcgtcaggccttccgcttttacttcaatcaattcagggtctttcatatatgtgcggctcagcttctcgacgtcatccggcagcgtcgctgaaaacaacatggtgactctgtttttcggcagatgctgaatgatggcttccacctgttcaataaatcccatattcagcatttcatccgcttcgtcaatcaccacatacgccagccgttcaagcggcagcgtccctttttctatgtgatcaagcacacgtcccggcgttccggcaacgacgtggcttttttgcttcagttcggttttctgtttgtcaaaagaagcttttccgaaaaccgccgtggcttttatccgtttgaaacggccgatattcgtgatatcttctttaatctgcgccgcaagctcgcgggtcggcgttaaaatcagggcctgcggtttgttttcctcccactccgcaagctcgcagatcggaatgccgaaagccgcggttttgccgctgcccgtctgcgatttgacgacgaggtcttttttttgcagcgcggcggggatgacgcgccgctgcacttcagtcggctcggtgtattgcaagccattcagcgcccgtcggatctcggggctgatcgcatattcattaaactcattcatgactaaactccttctctgtccggctcccctcattatacgcgaaatgccgccgctttaccctgacgttttgccgggccgttcgggggactgctttttcttcatgtcgagcacgacccatttggcgcaataaaagctcatgcttccttccccgtcatcgacatagtagcggatcgattcccagccgccgtcgaccgggctgatatccagatggatgtcggtgatgctttcaagatcatccagccgggcagacctcacatcctcaaaccgcagtacggcatcatactgtccgtcagtcagcttcagctcaaacaccgggattttatcataatactcgttatacccggtatagaacgtaaactccgtcaattcaaaacaacccggcgaacccggccccggcagaactgctttctcatgtttgtgccactccattttgcgcctccttacttaacaccttcttctctgctgcttcatattgacggcagtaaaaacggaacgtttggttctcccactcctccacgagaaaatgctgtccatcatctccgtcagcaggatcaattgctacaatgcctgagccagccgtttgactctccatttctcttatttgaacggaagaaacgtctttgcatgtgagccttacacgaatgagctgatgttcatactcagaggaaaacgccagctcaattacagaaatctctcgtccccgaaggaggcggaattctaaaagctcctgaatcagccacttattctttttcattttctataaattctcctatagaagcggcatacaactcaacatcggcagtctcatgatcccacagatagacagtctcctccattacactgtccgtctttttcaagcacagcttatccccggttccgttgtcggcaattacgatcaaatcgtcgggcatactctcttctctgcacacactgttttgcctgatcacatcatcccaggttttctgcaaacggctttgttcacggatagcgaaaaaaatccactctccgatctccgcagggttctttttatgaagcagccgtttatacgctttcggaaaagacgctctcaagcttttttccgcagccctgaactcttcttctgtcatcctgttattcctcccccgtaaaaacatgagattcatttgcaagcggtcttcacttttgaaataagacaggagagtttctttctatcgcccttattagcggtgagccaaaaaccgtaatggtttgctgccgcggatcccctagcagcccccactggaagtcctgatgaataaagaaacaatagtctccatttggaataacggagaccagccattcaccgaattcatctttatcaattggcgcatgaggattaaatagataacattcatgctgccagtccagcgcatatataaactcttgctttaaggtacaagattgaagtgcctttagtatctgcagtacgatgagttccactgcattcatggtcagaatgattgggtcgcttgtgtttatttttgtattgatttttgtaaagactaattccgacatgaacgcaccctttcttcatgcgttttcatataaccctgcacccaatcttttaattcttcaatcgtatgcagatacgaatcaggcgaatctttcagatcaaacccgctcaaatacacgagcatctcccaaacgttttcatcctcaacctccggatcatctgcagccacgtactcgcatgcccaatccgacacttcttccctcgccgcttgatcgttcaggatcagaccagccttcttcagacattctgctcttgtgggttctttcacgtcacaatcctgcctttcattttttgtttaaaatgctgactaacagcctcctggcccgttcatgccgctcgatttcccggctgagctccggataatccattaaagcgtttttccgctgcgcatattgcggatacaactcaaaaaaggatttatataaggctttacgctgccgcgcagggatttgtttattcgccaaaacaaaatctaagctgccgcagacaagtgcgaagtattcataaaaatccccagcgcaggcagcaccctcaaagtcttcttcgaatctcccagcatctgaaggcagcggcccctctaattcttttttgtataatttcaggtttcggatgacgtcatcatttaaagaatatctgatggatcttatcatctcattttgatgcttttccattactgatatcccgcttataaatccccgaattcgagaccgcgtaaatggcatcgccagtcagcttcagctgatgcccggaaagctcatcgccatccgcatcacagcacgttatctcttgcatcggcagactgacatcggccggaatgagagacagtgaatgatcatctttgcatacccaaaacccgttatctgaaatcgctagctggtcgtaaaccccggaatatgctttatcagaaataatccacactcgtttcacgtcggtttcttcaaacgcagcaatgactgtataagcgtaatacagcatgtagattagtccgtctttttctgcaagtgcataacagtcatctacaacgggcgcatatatttctgaaagctgttgatcaatatgcgtttcctttaattgcccgtctaaagtgaagcacagcacactttgaccatttgagttttcatcatcataaatgccttcatcacttaaaccgatccataggttttgtttctcatccagaagactgcatgaagcccctgaaggcagagaaaatacactttgttcttttccatctgttgaaaatactttcactttatactcatgcgattcaaagaaaatcagcacatacctgtcatccgaactctgttgaaacagcataatatcctcacacggaatttgttcatcgatatgaacctctcgggtgtcgccggattcctccgtgatcgtaaacgaaagactgccattctgatgccgtccgagatacagacgcccccggtcatcaaaatggatgaaacatccttttactggttcgtcatgtagcttgttcatttttattttcatgtaattgccccttgctatttataatgagcggcgagctttctttgaaattcatccggaacgatctgattcgggaatacaactgatatccagtctaaaacacggtcgtctaagggcctccatgatcctaacgtttttcccgcaatctcctgatcaatacctagaatacagatttcaaaatctctctctccgtaaatcgcccactttaaagtcggtgaagcccatacgacgcgggatgcaatattcattatgctgtcatttttactgtactttggataatcagttaagattgaaagatattcatcttcggttatatttaaaggaatctttaaccagttaaaatatccgaattcctcgtaaaaccgattcatatcatccggttgtgtcagaacagccattaagataaattcatcgtgatgatgatgcgccaaacttttgagcatttcccagccttcttcagacaagacccagtggaattcttcgaatagataataatgttttcgttgtttaaaaacttgttcgggcaacgctttgtcttcatgaaataaagaatatatttgaaattgaaagactgccgattcctttgtgttctttataaaaaagggatgcatcttgtacctcttttcggcggtttacacacaagctcacagccgtattctgtgtgaaataaacagacagaaaatgagaaggacggctccactaaaatacagctgttagaaagcagccggccttcaaaatctataaaatccatgagacagtgcagatgacttgcacaatccttcagcgcacatttgatagcaccgacttcattactatacggatgaaacagataaacaatatcattcatccgttcaacccccgtatccgcaatgttttctaaaataagcgatatggctgtctccttgtcgcttatatcaacttcacgcactgcacttgggaaagaattcgataatatagtctcaaatatctgcctgctttgttctgcctcagctaattgataaacaaaccctgattcttcacaagatcttagcgaggcacgcacctgtttcattaaaaaatgcctcttgttttcctcaagcttgtcaattaacttttctctcatcactgaacacttccttacaggatattttcattctgccggcatgtatgctgcatagaagtaatcaatacttcaccagatataaatcgttatcactaaagataaacatgcgatcctgtacggctctgtacgttgtttctccttttctatcaataccgtgtatcatgacgtcagtctctttgtgctcttcatgaaatgcaaatagggtatcatcgtgactctgaatcagcagcaccctttttttcgaaacggatagctgatcacaataggagtattgatcgccgtttagcacatattctgcaacagtacgaattctgtcccgtccaatctgataatgaccgatgacacagcaatcctctccctcaaaacatacatacaaatcagatttgatcgattgtatggcgtagcattcgtgcatcatttctttaaaatcgtctttaaaataaaacgttctgtcttctgcatgaaaagcaaatatcgctttcccttgagggtttctctcatcatacataccctcgtctgttaatccgatccatagtaatccatcctcacccagatgaaatacattggcgcttaatagaaaagaacaaatcggattgattttattactgtttacgcagtatacagctaattgacacgtatgattttccaggtaaacgatcacgatagtgtcatcatacgaatcaaccagatagaaatgggcatcttcagaaaatccgtgtaactcttttttgattaaaagagagctgcctttcataacctccaatattactttgtgatcatgcaccgacacaataaatacttgatcatcccgacccgcattgaaataaatgatattttccctttcatatgacccaacacgctccgcggtaagttctaacatcagcaacactccgttgatttaattatttttcagtacggaaaacttgttctcagtttcccattcggctgaacaaccactctaaccctttttgtcttcttccccctactatttattccaacataccttttaaattttttttcgtatacagtagcacctgaatgacctggtctagcttttcctctttttaatgtgtgtctggtcgttcttttcattgctctattgctcttgaattttcctttattagggattttagatttaggtgcgtgacccttctttatatgtttccagtcaatttgctttacttttctggaactgctcgcaaacttataaacccttttagcacccttaaataacttcccaggaccaaagttcgaagccgctgcccaggctgcacctctccatcctttacctgatttatatgccttatatccgtcataagccgcaaagccggcgttaatggctagccacacccaatgcccatctggatcaacattcatcaccgggttgttgtttccgtatgcatatccattctgatctaaagaatcgccgtcacttcccgggtctgggtctagtgataagaatacaccgtttcttggttcgtagtagcgggccatgagatagtacaggccggtttcttcgtcgtattggtagcctgcgtagcggtagcggttgtcttttacttcgtcgctcgcttcggtttttgtcggatttccccacgcatcgtactgatatttggcaacggtttttccggtgctgtctgagatggcgatgacgtcgccgtgtgcgttgtagtgatagaaatatttcttgccgttctctgtataggataacagctggccgctgtcaccgtacgtatatgattttgtgacgttgttgtcggcgtctgtttcatacagaacgttcaagctgtctccgtcatagaagtagttcgtaacgtttccgttgacggttttttggattctgtttcctttttcatcgtatttgtatgttgcgaacggcttgtcttcgcctttttttgtgacggcggtcaggttgtcttccgcgtcccacgtatatgtgtatttgccgtcagatgtgcggttgccgtttttatcataggacaggtcttcgtcattcaccttcgtcagctggttcatgatgttgaaggatgcgttgactgatttgcttgcgccgtcctttgtggtggtaacatttgtccggttgccgaagccgtcgtacgtatattgaatgacggtgccgtcttcatgagtttctttgacgagctggttgagcttgccgtattcgtactgcacctttccgccggctgagctgtcgatgaccgtgcggttgccgttggcgtcgtattcatagctttcccggaagatgctgccgccgtttttggctccgatatgaagagagctgacgagattccgctcatcatacgagaagctcgtgccgacttcattgccgctgatgaatgtctggacattgccgttttcatcataatcaaatgtataggctgaagtgccgtcgttcatttcaatcatttgatcaagtttgttgtacgtaaagctgtttgttcctttttggccgccgtggctccatgagaaagttttcagcttatctgaatcagccggatacgtccagctttggctgccgccgcggtcggttaattcggtcaggcggtttttgttgtcaaaggtgcgttttttcgttgtattttgttctttgtttgtgactgacgtttcattgccgtttttgtcataggtaaagttgtatttttcagtgccgttatacgcttttgacttaacccggtcggtgccgtcataggtcagcgacacttcattgccgttggcggaaacggttttcgtcaggttgctgttggcgtcatattcactcttcagtacattgccgagcgggtcggttgttttgacgagcttgcccatgacgtcatattcatattgataggtctggtctgcgccggcccgaatcgtttttgtcagctcatttccttccttgtcatagctgtgaaggatggatgtgccgtttgacagggtcagctttgtcagctggtcggcctgatcgtattcgtaggcggttgtttcgcctttcgcgtcggtttcagacattttcttgccagtctcgtcatatgaagcagtgcttgcataacctagttcgtcttcttcttttgtgacgtagtttcctttttcgtcataggtgtttttcgtcaggatgcttccttcgattaatcggatgtcatcaaaccacgccgttcctgtggcgcttttttggaatagaatgctgatttcgattttattgatcggctttgttttcggaatgactgccgccgcccggttccattcctgtgtcccctgcgggaatttggcggtgtagacgcctgtcgtgccgtccgcataggtgacgccggcctgaagcgcgtaatcattgtcgttcgttaattttacgccgtcagccttggacatccctgtcagcgtgatatataccggcttatcgtccgcgctttggcctaatgtaatggtttgttttgcggccgcattggcttgtgatgcatttgtgcgggacgcttttaatgagctgtcatcatcgaagccttcatcaaggtcagcggcggttccgcttgtgctccatccgtctgttttggccgtgaaactgctgttttgaaccgggttatagcttgaagagacttcgcctttttccagctgaacctgatcaaaccacgcttttcctttgccgtccttgtctttatgatccacttccatatagacgatggcttttcctgcattggccggtgttgtaaatgtaatctgccgtttcgtccagtcattctttccggctaatgcgcctgattcattgtgaatccattgaatgcgtttttggtctttgtcacgcagatcaatgttgaaatacgctctcgcctttgtcagatccgttttgatctggccgctgagtgtatacgtcgtattcggctcaagctgcacttcctgcgttgcggacgcatggccgtgctctgttccggctgaagcggattgtgaggtgatctccagtgctttttgtccggacagcgcgccgcttcttgcttttacagacgcgatgcttccgctgtctctcgtagcggtgagattccagcccagctttgttgcttcaaagctgccgtctttcagcaggcttgccgaagctgccagctctttgcttgattgaatgagattaccgtatttgtcatacacggcggcggatgaggattttccgctttgatccgtttcagaaacggcatccagtccgtcgtacgcaatatcagtgatgttcccctcggtatccttcattttcgttacgtcattgtttttgttgtactgatacgtttcggtgccgtagttgtcttttacggctgtgacgttgccgtctttatcatattgatagctttctgtcgctttgcccgcatccgcgtcgttcggatcggtgtcctgaatgacgttgttgccttcgtatacagtgttggtcgtgattttcagcccttcggcatcatcgatcatctgaatcgggttgcccgcctcattatagccgtactgcactttgcggccgttcggctgcgtcatgagcagcgtttttttgtccgcgtcatagctgtagtcgtacgtttcttttttcgcattgacggctttggtcagacggtggccgctgtattggtattcagtgaacagcggtttgtcacccgtgctgtttgcggaatactgcttgacgaggcgcccttcggcatcatagtcgtagcttgtgacgctgccgtcagtatccgtcacctttttgagaaggtctttgtcatatgaatacgaaatctttttgtttttcggccctgtaagagatgtgacatggccgttttcatcataggtaaatgtcagcttgcgccctgatgcgtctgttatggcggtcagctgattgctgtcgttatattcgtatacggttgtgttgttgtgtccgtcaacgactttttgaagcttgccgccttttttgctgaaataagcgttcgtctgatcctttgtttttaatacaaattggtcgcttgtttctgtcagttcgagataaacacccgtcggcggctgatacgtgccgtcagattttttcgtgaagacatgtgttgtcgcgtcctcatcaatataaacggctctgccgtcttcagaaaggatcgacgtttccgcatcggcataccagccttggccgaacatatggtcagagctgtcaaggctgttgaaggtccgggagagtccgagccccggtccgcgtccgtcgattgacatatcttcttcattgacgatgacatttcccgtcgctccgttcagctgtccgtccggaatgtcgataatagaccagaattcttccgttccgaggaattccgcaccttcatggaaaacagggttaaaaggtgccgtcggtatgctgtcaccgtttgcgtcataggcggtcagcgtaaaggaatagttcttcttccctttgtaattgccgtttgcgttttcgtaaacaggtgaagggtcaagcgccagttcgccgccctttccgtccttgtgaagctggaattttcccgctttcacttcatcggctgacggccagatgtgtttgttttgggtcgtccaatgatcggtatccccgacatcgaatgattgatagtcttttccgttgtagatgttgattttgtagcctttggcgtttttgactttatcccatatgagattgacataacccgtttggctcgatttcgtgttcgtatagacgtagcctgtcagatttttcggctttgcgatatcaggcagcgccggactagcttccggtgaggcgatcgcttctccgtctttgttataggcgattactttaaatccgtatgttttccggtttgcgtctccgccggcgtttttataaacggggcccgggttaatcggcaattccgcgccttttttgtctttcaggtgaagcgcatattttccggcgctgatttccgcctttgtcggccagatgttttgatcttttgtggaccaggatgttttatttccgaggtcaagcgtttcaaagcctttgccgttaaagacttgcattttatacccggctgcgcctgatacggctttccaggaaagatcaaaccagcctgtggcgttgttgttattaaagcctttcgtgcttggtttctgaactctgccaatattcggaatgacgggcttggcggccgcagacatggcgccttctccctggtcaaacaccgcgctgaccgcgacccagtaatttttacttgccggatagctgccgccggagtttttatagaccggcgaaggattaagcgctaattcacttccgccttttccgtctgtatgcagcttatatttgccggagtcgatttccgcttttgtcggccagatgttttttccttttgtgctccaagaggttgcattgccgacagaaatggcttgatattctttcccgttataaagccacactttatagcttttggcgccttcagcttttttccagctgatattgaaaaatcctgtcgaatctccgttatgatacgctttgacagacggcgtgtccgccttcggaatcgtgtatgtcacttcaatgtatggttttttagcagagtttgctgatgacatcagcttcttccaatattcttttccgttgccgtttgtgtgaagcttaaagccgtaattggcgccgccgttgttccacgacttgactgcggatgtgacatcgaagcttgcccattggcctttatagacctcggctttgccgatgtttttggagcccggcttgtttttccacgtgatcttggcattgtcgtaattgctgtttacggtgtcgagccaaagccccgtcgcctttgatccgtaataggagtggactgtgtatgctttaagcgtcgcttttgtcaccgtcatgtttttgatcggctttagattatcaaacttcataaatgcgtagttcgttccggttgtgccgtcataatatccagttttcagcacgtacgctttcaatccggcatcccatttctgcgatgcggcagagtagtttgtcgtcgggtacgcgctcatgacaaaggtatcggatgacacggatactgatgtcgacgggtcaatagataccggataaacccgcttgggatctttcagccatttttcatcggccgttacatgcagcaagtagccttcgctgtttttctcaagcttgaagctgacatcttctgacctgctgacttcacctgacttctcgtcgagatctgagtcggtcataaagggcttcggcacggtgtagacgacattgtctttgtcatcagaaaacgcgatcgagccgtcttcctgttctcttgcctgaaggtcggttttgatttgaaaggtgaaggaattgtagccttcatatttgtgaagcacaaggtcttcttttatgttttcgttaaatgtgtaggtttgtaaatcaatagcaggaaacacttgctgatacgtaagctcgttgctgtcttccttcacttttgctgaggcatctgtcggagtgattgcagcctgatcggggccttttgcgccggttaatgagtatgtgagcttataatcatcatgttcaaatgtagcgtataatccgtttttcatttgcttcagaaaatcggagttcagcactgtattttccgtcccgacatcctttgagccggttttcaattcaggggaaacgtcttcccagtccgcattggcggtttctttcgtgtgaatggggtctgtgtagatttcctgtttgtatacaccttcgccctcataataaagctttgaattcacagttctttcagacgtgatctcaccgtcttgattgatatctttttgatcaaacggcatctgctcggatgctttttccgccggaagatctttttccgggtctgctgccggaatggcggcggttttcgcttgatcttgtttttcacgcgtttctgccgcaaatacatcggcaggcgcaatggaaatcataagcgttgccgcaagagtgccggccagccattttttccacttgttcttttttcctattttcataggttctcctccttcttttgtaatataggcttaacaatagtaatattattgaaattgtttatcaatattttcctaggtatttaaggttattttaaggattataggaattttgaaccttttattcatataaaaaaaccgccggctgccggcggttttttgtattatggatagcggagatttgtattttgcgctcccgcgtaggattgggcgaagtttttggcgtcctgggctgaaagcgtgccgtagctgtaatttgatctcggattccagccggtgcgcggtgatttcggggctttgagcgacgggaatgaaccgatgtcggtgaattgggccgtcccgtagtcgtctatcattccgcctttttcatttccgttaccgaaatagttggcttctgagaagacagtcgcgtttgtatgaatggtgaatcctaaattgaaattggtcacatagttgttttttgcgtgaaaatagccgtatctcatcaggcccggtgaacgcacatagacgttattaaaatagttgttggtgatcgtcatatgcggatagccgatataattgcgtccttcgttatcatcattcggataaccgagaatcaggccgtacagatggtctgtgaatttagagttagacagcgtcacaaaatccgctttggcgccgacatacagaagcttgcccaaatcgctgtggctgttcggattgtagctgtgtccttcaaaccacacgtggtcaatccagtaattctgcccgttcgctatgtacatcggaatgtcgttgttgcctgtaatggcggcattatggctgataatgagatttttgaaaatcacattgtttgatccggagccggtggtcagatagatgttggtcagcctgtggctggtataagagccgacgatggttttattggcgccgactgtcacaacggctttccccggggaagaaatatcacttgtgatgacgatggttttgcggtccgttccgcccgcattgtttttcagatcattgagattgctgacgtagacgacggggccgccctggcctcccgatacggcggattttgcttttccgttatgatccttcgcattgccagcgaatccggtaagtccctgcatcacatccggataagccgctgccgcttctgcctgcttggatgcggaacatacgatggccagacaaagcgcaaagccgagtgcagccaagaaagcgagatgacgcgtcttctttttcatgcccttcactcctttaatctcttaaattgcaaacacatgaagtattatacaattactatcctctttttccatgatctgtttgtctgctttttcgttatggctgaaaagccccaaaataaaaaaagcagccggtacggccgcctatatacgggtgctgtctgcctgagtttccgtcggcacggctttttgctttcgaatcagggacaacgccattcccgcaaaaatcaatacaatccccaaagattgataaaggtcggggcgaaaccccgtaaatacggtgtcaagcacaatcgccaccgccggatcaagaaatacgatgattgatataaaccgggtggataaaaaccgcaagctgtcaaaaaagagcaaatacacaattcccgtatgaatgataccggttgacacaatcatgatccagttcacatgcgacaaatcagaaaaagcgccgaaacggacgaacgggagaagaatgataacgcccaatccggtctgcaaacaggtgaccgcatatgggctgagactgttgatacctttcccggccagtgtcgtaaaggcgtaaaaaagggcggccagcacggcccaaataatacccgattccatcagctgagaaaatgacgtacttccgttgatgccggaaatcagggcggtgcccagaaaacaaatcacgatggaagtgacggacacaatatgcagtttctcccggtatataaggctccctagaagaaggacgagaaccggagccagatgataaacggaaatcgctatcgtcactgatgtttcctcaaatgatttaaataaaaacacccagttcagcacgagaaaaaatccgcaggccaatgtctgcaacacctcgcgccggttccattgttcggtgcggtgccgtccggaaccaaaccagcaaacgcccagaaacaaagaggcgcacagacatctcacaaagaccagttcaattgaaggaacattcgtatgttccgagaaaaagccgattgatccgaaaatgaccatggaaatgaccattttgatgacggcatttgatgtttgttcagcttgcattgattcgcttcccccatatcattgactgtttattcagacaaatactaacagccattttacttgattcagaggaagatttcatcctatttttcgaaagacggcggtcttttctcattaaaaaaagcccccgcatcagcagggccttctgtttaatgaacgatcagtacaggacaaggagacaattgtgagaccttatggctcacgcttccgagcatcatttctttaaatccgctgattccgcggcttccgacgacaatcagattgaaatgctgttctttcgctatgtttaaaatttgatgcgcaggttcgccttggacgtacaggctttccgcatttaccccgctttctgccgctttctgcttggcatcttccagaatggccgctcctttttgctcgacttcatgtttgatgtcttcaatgaagttttccggaacatagacaatccctgttaaggctgatgtggatacaacagcttcacgtcccgcataaagaatggtgagttgagcctgctgttctttcgccagatggatcgctgcgtccaaagctttgctgctcatgtctgaaccgtctactgctgcaagaatttttttaaacatatgaatcccgcctttctgcttttattgtcctcctctctttgctgaatgtcaattttgccggctttctccggaacattgcgcttacagactttctccgtttgtggcgatgacgtttttataccaaaccaaactacctcagcgttattttttaagcgcttaataaataggactttattctcttctttttcagtattacctattggtaaaagtagtgataaaatggaattattgatataaaaaaggagattatgatgagaaatcatagaggcttccatgaggaaattcagcaacaacaaaaactttatccaacatcacatcgcattcaaccggtcagcccaaaagaatatgcagaggttttgactttacatacggcaaaacaactgagcgagacatttcaaacacttgtggatcaagatcagtatgaacaagcgattcagctgagcgagaaggttgcctctcagcttggaaaacatacgaatttttcattgccactttccacagtgctttatagtttaaatgaaatggaacttcctatttcagaggaattttctctacatcgtctgaaactgctaggaaatcatcaaactcatgagaactttttcaaagcattaaaacacgaaatgttaacggcggatcgggtagactttatggttagtttcacaaggtggtctggtgttcagcttttgatccctccgcttcaggagcttgctaaaagacatgtccctgtacgcatcattacatctacctatatgggtattacagaaccgaaggcgttaagacatcttcttcaatttgaaaatgttgagttgagaattgtaaatgaatataaaaaatctttccatacgaaagcatacttatttgaacgctgttctggacagcatagtgtcattgtaggatcttcaaatctatcacaagctgcccttacgactgggtatgagttaaatgtgagactacctgaaaccagatatctccccgtttatcaacaaacaaaagatttgtttgacactgtttggaatgaaaagacgcagcctgttgacgaacaatttttacaagcctatgaggaattccaagctggaagccaaaaggtaagtgcttcctttgctgctcaaaactctctttacaaaacgaaaatgtccccgaatgccatgcaaaaggaagcattacgaaaccttaaaaaaacaagaaacgaaggggagacaaaagcagtcatcatcgccgccactggaaccggaaaaacatttttagcagcatttgattttgagcaatttaaaccaaataaatatctttttcttgcccaccgggaagagttactttcaaaagcaatcgaaacattcaagaaagtcacaaataatcatgaagattttggcttattgactggcacgaaaaaagaaagagataagcgttttttatttagcactatacaaacgttacataaaaaagatactttggaatctttttcaacagatgagtttgactacattgtgattgatgaattccatcatgcagaagcatctacctatcaagctgtattaaactactttacaccaaagtttttattaggtttaactgcaacaccagagcgtcttgacggtaaagatgtgcttcagatttgtgatcataatgttgtttatgaaatcagactccgcgatgccctaaaggcagagctacttgcgccatttcactattttggaatttcagatcatactgtagattacgaaaaagtaaaagtgaaaaacggactgtacgaagagaaatcgctagtcaatcatttaaaaacgcataaacgagtagaatatatcatcaagatgatcaacatgtatggattccacggcgagaaaatggttggcttaggtttctgtacaaacgtcgaacacgcaatatacatgagtgatgaatttaataaattgggtttttatacaacttatttaacaggaaatgattctcctgcaaaaagacaagaggtcattcgtcaattagaggacccgcaccacagtttagaacttatatttacagtagatattttcaacgaaggaatagatatcccaaagctcaatctactattgttccttagaccaacggaatcaccaacgattttcattcagcaattaggacggggacttagaaaaactgacgacaaagagtttgtaacgatactggattttatcggaaactatcaaaagtcattcgttattccactcgcactatctggacaaacaagccaaaaatcgtttgataaagattccctccgagtggccgtgacgcatgagttttcagatttacctggaggatcttatgttgacctttcagccataacgaagaaagaaattttaaataagatcgatcatattaaactaaattcagatgccatgctgaaaacgttatacaagcaatttaaacaagagctagggcgctctccagaattaattgattttctatactctgaacaggcacctgggcttaccttttttataaagaaatacaaatcgtgggtacagaccaaaaagaaaatggacgatttgaatgttacagatgaagggattctcaataaccccttggttgtagggatagtagcaagattagaacagcaattacctattaaatggccttatgaatggttaattttacagagcggttttcacaaaaatatcatcacaatagaagatgtaaaagaatcgttagaaaaacagtttcatattcaaatcacaacagatacacatgatgacctcattcagcgagcaatggagcgtttaacgaaatcagatcaaaaacagaattggcgctttggtacattacaaggtgatacattcaagttagatccagaagtaagcgagattttaaccgatccattattcggaccgtatattaaggagcgcgtccactatggactgattgaatttagacgtatgaacaatatagaagcccttgcttcaaaagagattaagctaacattgtatcagacctatacaagaaatgagctcatttatctttttcagtcaactgatcaggaagggacttggcgagagggtgtacgtagagttaaaaatcactatttaatctttatcaatttgaataagtcagaaaaagtagaagatcatttgctatataaagattattttattgatcctagccattttcactggcaaagtcaaaaccaaacctcacatacatcaagcgtagggcaaaactttattcaccataaggaaaaaggataccatattcatttatttgtgaggaaattcactgaaatgcacaacatcactttaccatttatttatttaggagaagcggattacgtatcaagccacggagacaagccaatgaatgtcaaatggaagctccatcagcctgtcccagaaaacttgtatgtggatttaacgaattaaagcagatacggtcggaagatcagcgggtgcccactctagtgattctagctcacgaataggcacccatctgaattccgcatgctcttttgctaccggcttccctgatacaatcttcgcttttattgaaattaaattgacgatgaccttctcatattcatgatgaatatcagctatcacatcgcccgtaacaattttacaatcaagttcctcttcaatttctcttacaagtgcttcccgagcattctccccttcttcaagctttccaccaggaaactcccacagattaggaagagacattgttggagaacgtagagcgcatagaatttcattgttttcattttgtataactgcggcggctacttttattgtttttttcaaaattaaacttcctttcgttttttcttagtcggtagctcagttaaattactatttaattataatttatgttaggaaagcttttttctattttctgaaagagttcagttggttaacaaaattctcacatcttgaatatcttgttagttcacttttattatataaaaaaatagcactttttataaggaggttaaaaatgtgattatcctcatttgtcaaggtcgttttcttataaatgcttattcaaaaacagttttatacgctcaggctctctactttcgttagttctcaatctgagtatgggtattcctgctttatctaaaattgtgtttttaattctatctcgtctcttttgatctttagagtgatggtatgcaacaccatctacctcaattactccaagaggttcattacccatcttataatgaagaagaaaatcaactcttgccgctgttttaataaattgtttttcatcttcatgtaggtgacttgtttcattcaccagatctttcaaacgatactctcttttaaagttgatttttttaaatttttcttctgaaagaatatccctaagtaagctggctataattctttctgtcttgtattttgaatcacttttccgaagtctattttctctttcaataagtacttcagagaattctttataaagtaagtcaaacactgaaattactttgctttcatggtataaactcgattcagtatagtattccatatacctaataagttcggaaatttctttgttgctttttttaaatacttcaacatcagatactaaaacaaaacgctttttagctcgtgatatagcgacatttattaaatttgcgctatcaacgaactgaacatcatttttacttccttttttatcaagcacagtagaaaaaataataccatcgcattctcttccctggaatttatgaactgtatctttcaaaatctcctcaggaaaacgctgttcggcatgattaatctgttctctataaggagcaataaagcctgtttcataagattcaggaaacacaagatttttaatcgcatcctcatcaagagaatctaattcacgaatattatgtttcccaccctgaaaccgcatatgattacctttaacagtcttaatgagtacgatggaaggttcattttcacttttttgttttgtcaaaggaataagtttcccatcataatattgttcattacaaaatttaattatcatcggctcacaacgataatgttcttttagaagagtaatcggtattcgattcttatatacttttataatcgaatcaagcatactattattaacataattaaagcatgattctatttcaaattgggaaagctcggctgatgtatcgggaatgtgggggagctgcttcctatctcctactatcacaacattcttagcacacccaagagcaagtatccctggcattaattctaattgcgaggcttcatctataattaagtaatcaaacaaaaaacccgcaggtatagacttttgcaacgaaaaagcagtactcaatataatggggaattgatctataaatgatgaaaaatatctagactttttgaaattttcctgagtataatgggtttttctgttgaaatccccctttttattcaaataacttttaaaaagttgttttgagattaattgaattctttccgttaaatcattgaagtttttcatttccagaatgtcttcaattcttttaatttcactttttaattcctcaagctttagtcgataaaaatgatattgaagctgtgtaatgattttttctttataagattgatcttttatttgtttcgggctgtataagccataataaaaaagatattttgtttgtttaaacaatgtcattctattcttatgatttaatgcctcatcaaccaaaaaatcgatgatcttatttttcgtgaatttgtaaaatggtagaagttttggttgaacagcttctagtgattctaaatgttttgtataatatttctgttccgtttcaagatcttttatttgctgctttatgactgcttgtttgttttgtaattcaagtaactctttcattgatctaatattgttccacagaatttgttccatttctacttcaacatccatattaatttcccagctattgaagtcttggggaagctttggaggattctcaaaaaatttcttctgattcacctgacttcctaatgatgcaagaaaaaaacctagatctgacttcattaatttctcactgacatttgcgacggcagaattattactcgatacaatagcagcattttttccttgcattacaatgttagaaacaatattcaggatagtttgtgtcttaccggttcctggcggtccttcaattacgctaacctgagaagaaaaagcagattcaaccgcttgaatttgactaagattcaaaccaaacggatatataagctttttttccttattgaaggattgactagtttttgtaaaataagcatgaagagcactttctgttcttagaggaaggttatgaatttgcccttctaaaatagcaggtataccattaactgttctatcctttaccccagctatgaaagaaaaataatttaacaggtttttgaatttagcattctctagccttactttcttaaccgcatcttttttataaatatatctttgcttaccacccctgaaagaaacaaccgcatatttatctccataaataacagaagactcgatgttcttactaatctcaccatttaattcaaaaacttcatcttcacttaacgtaagttgttcaaatggatatactttgcaataatctagctttttgactattttcgttttatcatttaacaccatatgtatagtaaggttgccattttgactgttcaatttccatgtttttatttgttcagagtatattgagtcttctatctgaatgattgtacgtaccaattgagtacccccgtgtcccaaaaatgtgtgttaatttattttatagtatacaaaattaataaactctttacaaaatagtacaaaaatagaaccctctagaagcaggagggttctaaaaaagtttcacttcactccccaaacagcctccccatcaccgctcagcacactaaacgtcacaacttctttctctctcgctgagtcccattctttcaggaagacaccgtcataatgtgtgccgttcaggttgattcgggctttgctgctgtccgttattgtccaggttccggtcatttccccggaaatggtgccgtcgttgttaagccggatggtttttggggttttgatcgtagctgtaatgtcttttccgtgctggatgagtttgtaggctccggatgcggcggctgccgatatgtgtgtatccggttctcctgcgtagcggtacggcgctgcaacgggccatccgtctttgttcatgtacagccgatgcactctgacttcgtgctcttcgcctctgttcgggaaacgggtgtggaaaatgaggtatgatcgtttcgttttcccgtcgtaaaacacggagttgtgtcccggtgaaacgtagcccgtgcctttttcagattgtgaggcgaagctgtagccgcccatgagtttgaccccgtacggttcaattgctttgtcatcgaagaaactgccgtcttttcctttggcgtcaagcatgttatggcctgcggcgtcatagtacggaccgtccggatttttagagcgcgccacacgcatattgtagccgccggctgtgtcaagtccgccgaatgacagatacagatagtaatatttcgtttccggattgtagctgatgtacgggccttcgattctgctgtgatttccgccgagcagtttttttccgtagccttggttcgggagcgggaaaccggttttcggattcatttccagtataaaaatccccccggagtaagagccgtacaccatccagagcttgcctttatggtcaaaaaacgtttgcggatctacgacgttcgggtgaacgtttgcatgatacgtcgtgccgtcttcgctttttccttccatgcctgatttcaaaaagatgcctttgtttttgtagggtccttcgattttgtcactcacggcgacaccgagagcggatcgcggcgagtctcctttacaggcgttatagtacatgtaatatttcccgtcagccagctgagccacatccggcgcccacagcgtatcagactgggcccagtcgaatgtctcttttaattcggagtagacgttcgggatcaggggattattgggattgacgcttgaagacagttgctgccactgcatcaggtttttcgacttggcggaagccaaatgcgagccgaatacatagtatgtatcgcctgttttgatgacggacgggtcatgcacgctgacctctgaaaaaacgggatgctgggcttttgcctgcggcagagtgaacccgataaccgctgctgagaccaggcacacacgaaagaaactggttttcattttctgaaatctcctcgctctcttcttttcttaaaacgctttcaagacaacgctccattttatgacgcggatggcggaaatatgtgatcaacagcgccggcttcccgatgtaccgctttaatacaatagcaatctgatttgtgaaagactggaaaaaaagttttgacttctgattcgcaaacacttaatataaaaaacagttactagttatcagaatatttaagaattgagtgaagcatatatgaccttacacaaagaccgccgcatcgggcgattgtccgtccttcttctgcttcatgagactgaagaaaaccagcagatcagccggctggaacgggacggctggaaagtctgtctcggcagggtgggttcaatggatgcgcataaggtggtagctgcaattgaaaccgcttccaaaaagagcggcgtcattcaatctgagggttatcgcgaatcacatgcgctgtatcatgccacaatggaagctttgcacggagtgacgcggggcgaaatgctgcttggctcgctgcttcgtaccgtgggcctgaagtttgccgtcttgcggggaaatccgtatgaaagcgaggcggaaggcgattggatcgccgtttccctttacggcacgatcggagctccgattaaggggcttgagcacgaaacattcggagtcggaattaatcacatatgaatcagcccatagatttcagatgatagggggctatgcgtgaaatatcattttcatggcatagctcctttttgtatgggcgctttaccaaagtaaagaaaaaggggttgaaatgatggtaacgttagacggttcctcactgacaaccgcagatgcccagcgtgtgctgtttgattttgaagaggttcaagcatctgccgaaagcatggaacgtgtgaaaaaaagcagggcggcggttgaacgaatcgttcaagaagagaagaccatttacgggattacgacggggttcggcaagttcagcgatgtgctgattcaaaaagaagacgccgcggatctgcagctgaatctgattctttctcacgcgtgcggcgtcggtgatccgtttccggaatctgtatcgcgggccatgctgcttttgcgcgccaatgccctgctgaaaggcttttccggcgtacggactgagctgattgatcaactgctcgcgtttctcaatcatcgcattcacccggtcatcccgcagcaagggtcactgggggcgagcggagatttggcgccgctttctcatctcgcactggcgcttatcgggcaaggcgaagtcttttacgaaggggcccggatgccggcagctcatgctttggaaaagacaaaccttcagccggccgtcctgacctctaaagaagggctcgcgctgatcaacggaacgcaggccatgaccgcgatggggctgatcgcttatctcgaggccgaaaagctggcctatcagtcggaacggatcgcgagcttaacgatcgaaggccttcagggcattatcgatgcgttcgacgaggacattcatgccgcccgcggatatcaggaacagatggatgtcgcagagcgaatccgctattacttgtcagacagcaagctgacgaccgtccaaggggagctgcgtgtccaggacgcctattcgatccgctgtatccctcaagtccacggcgcatcatggcagacattagcgtatgtaaaagaaaaattagaaattgagatgaatgccgcgacagataacccgctcattttcgaagacggcgccaaaatcatctcaggcggaaactttcacggacagccgatcgcctttgccatggattttctcaaagtggcggcggccgagcttgcgaatatttctgaacgccgtattgaacggcttgtgaatccgcagctgaatgacctgccgccctttctgagccctcagcccggcttacaatccggagcgatgatcatgcaatatgcggcggcctccctcgtgtcagaaaataaaaccctggcccatcccgccagtgtcgattccattccttcatcggcaaaccaggaggatcacgtcagcatgggaaccatcgcctcaaggcacgcctaccagatcatcgcgaatacgagacgggtgcttgccgttgaagccatttgcgcgctgcaggccgtggaataccggggtgcggaacattgcgcctcgtacacaaaacagctctatctcgaaatgagaaacatcgtgccgtccatacaagaagaccgcgtgttttcttatgacatcgaacatctgagtgactggctgaagaaggagtcttttctgccgaatgagcatcaccaaaaactgatgaccaatgaagggggacttacaagatgactgatgtaaagaaatcaatccgcgccggccgcggcaccgaacttgaatgcttaggatgggagcaggaagccgtgctccgcatgctccgaaacaaccttgacccggaggttgccgaaaagccggaggatctgatcgtatacggcggcataggcaaggccgcgcgaaactgggatgcttttcacgcgattgagcgctccctcaaaacgttaaaagatgatgaaacactgctgatccaatccggaaaaccggtcggactgttccgcacgcacagccgcgcgccccgcgtcctgctggctaattcggtcctcgtgccgaaatgggcggattgggagcatttccatgaccttgagaaaaaaggactgatgatgtacgggcaaatgaccgccggcagctggatttatatcggttcacaaggtattttgcaaggcacctatgaaacctttgcggagcttgcgagacagcatttcggcggcagtctgaaaggaacccttacgctgacggccggacttggcggaatgggaggcgcccagccgctgtccgtcacgatgaatgatggcgtcgtcatcgccgttgaagcggatgaaacacggattgataaacggatagaaacaaactattgcgaccggaaaaccgcatcaattgacgaagcgctgcgctgggccgaaacagccagacaagccggagaacctttatcgatcggccttctcggcaatgcggcagaggtgcatcatgagcttttgaaccgcggcgtccatattgacatcgtgaccgatcagacttccgctcacgacccgctgatcggctatattccggcaggatactcacttgaggaggccgaccgcctgcgccgggatcagcctgatttatacgtaaggctttccaagcagagtatgaaaaagcatgtggaagccatgctcgccttcaagaaaaaaggggctatcgtctttgattacggcaacaacatccgccaggctgccaaagatgagggtctcgccgatgcttttgattttccgggattcgttccggcctacatccggcctttattttgtgaaggaaaagggccgttccgctgggctgcgctgtccggtgaccctgaagatatataccgcacggacgctttattaaaagagctgtttccagaaaatcaagccctccaccgctggattgacatggcgcagaaaaaagtcacgttccaaggcctgccgtcccgtatttgctggctcggctacggtgaacgggaaaagatggggctcgccatcaatgaattggtcagaaacggcgagctgaaagccccgatcgtcatcggaagagaccatttagactgcggatctgtcgcctctccgaatcgggaaacagaagcgatgaaagacggaagcgacgcggtcggcgattgggcggtgctgaacgcgctgatcaacacggcatcaggtgcaagctgggtttcttttcaccacggcgggggcgtcggcatggggtattcccttcacgcgggaatggtcgcggtcgctgacggcagcatccttgcggaacaacggctttcccgcgttctgacaagcgatccgggtatgggcatcatccgccatgcggacgcaggttatgaaaaagcggttcaagtcgccgaggaacaagacattatgataccgatgaaaaaggagcggtaacatgccgaaacaaatagataccatactcaccaacatcggccagctgctgacgatggaatccggcggcccccgatccggcggaagcatgcaggatcttcatgtcacggaaaatgccgtcatcggcgttcacgacgggcgcattgtttttgccggacatcaaggagcggagaaaggatacgaggcaagagacattatcgactgcgggggacggctcgtcacccccggcctcgtcgatccccatacccatcttgtattcggagggtcccgcgaaaaagaactgaatttaaaaattcagggcatgtcttatttggatattctggcgcaaggcggcggtattttgtcaacggtcaaagacacgaaagccgcctccgaagaagaactgattgaaaaagggctttttcacctcggacgcatgctgtcatacggcatcacgaccgcggaagtaaaaagcgggtacggactcgacaaagacacggagctgaaacagctgaccgcggcgaaaaaactgggtgagcgccagccggtcgaccttgtcacgacctttatgggagcacacgccattccgcctgagtaccggaacagccctgacgaatttctgaatcgcatgctgcagcttttgcctgacataaaagaaaaaggccttgcgcaatttgccgatattttcacagaaacaggcgtctttaccgtcagccagtcacgggactacctgaaaaaggcggctgaagctggtttcggcctgaaaatccatgctgatgagattgacccgctcggcggcgcggaattggcggcagagctgcatgctgtttctgccgatcatttggtgggggcatctgatgcaggcatcgaaaagctggcggagtccggaacgatcgccgtcctgctgccgggcacgactttctatctcggaaaacacacttatgcgagagctcgggagatgattgatgcgggcgtacgggtcagtttggcgactgacttcaacccgggcagctcaccgacggaaaatctccagctcattatgtcgattgccgcgcttcatttaaaaatgaccgcagaagaaatctggcacgctgtcaccgttaacgctgcgtatgcgatcggaaaaggcgaagaggccggacaaatcaaagccggacgggcggctgacattgtcatttgggaagcgccgaattacatgtatatcccgtatcattacggcgtcaatcatgtccgccgtgtcatcaagaacggaaagaaggtcgtttcaagggagggagccgctcttggataagtatccgtttctgcaaaaagccggctccctcttcaacgaccgccatgtgacaaggatcggcgatgtaacggaagcgtgggcgggacaaacgatcaaagggccggctttgatcggcgttccgctttctaagtcgtcaatcagccattccggcgcctgctttgcccccggtgcgatccgccgggcgctcggcggcatttccgcatattccgcggagctgcgggagcatgtcattgaccatctgtacgatatcggcgatattcagattcacgtcacagatgtcgtcaaatctcacgaacacatttatcggaccatttatgacattctgacggaccagcctgactgggtgcccgtcattctcggcggcgacaactccatcagttattccaccattaaagccattgcggaaacgaaaggaacaacggccgtctttcaattcgacgcccaccacgacgttcgcaacacagaagacggagggccgacaaacggcacgccattccgccgtctgttagatgaaaatatcataagcggacaaaacctgattcagcttggaatcagggagttcagcaacagcttggcatatgaacaatatgtaaaagagcgtcaggcagacgtgcatacaatggagatgatccgggagaaagggcttctccgaacgatacaagacactttgccggccgttcaaaaaagagccgacgccatttttatttcggttgatatggatgtgctggatcaagctcatgcgcccggctgtcctgcgatcggccccggaggcctgtataccgaggaactgcttcaggcggtccggtttttagcccaggaggctgacatctcgggtattgagatcgttgaggttgatccgacacttgattttcgcgatatgacaagccgggcagccgcacacgtcattttacatgcattgaagggatttaaattgtcacgttaaagtcaaatccggcacgcgtgatctcggctgccggaagattctcatgccacgcaagaagggggagatcacgatggatgttgatcaaggcggcaatcaactaaagcgcacgatgaaaagcaggcacttatttatgatttcattgggaggggtcatcggcacggggctgtttttgagcacagggtatacattgagccaggccgggccgggcgggacaatcgccgcttacctgatcggcggcttgatgatgtatcttgtcatgcagtgtctcggagaattgtcagtagccatgcctgtgaccggttcatttcaaacgtatgcgacaacgtttatcgggccgtccacgggttttatggtcggtatcatgtattgggtgaattgggtggtgacggtaggatcggagtttacagcttccggtatcctcatgcagcgctggtttccccacagcagcgtctggatgtggagcgcgattttcgcggctctcctttttgccgccaatgcattctccgttaaattgtttgcagaaacagagttttggttttccagcgtcaaaatcgtcaccatccttttatttatcatcttaggcggcgccgcgatgttcggtttgatttcattgcacggttcgggagaagctccgatgctgtcgaatttcacctcacacggcggactgtttccgaacggctttcttgcggttttcatcgcaatgatttccgtaagcttcgccttttcagggacggagctgatcggaattacagcgggtgaaaccgccaatccggcaaaagatattccgcgttcgatccgaaatgtcgcctggagaacggtcatcttttttatcggcgccatttttgtgctgtccggactgatctcctggaaggaagccggtgtgattgaaagtccgtttgtcgcggtcttttcccagatcggtatcccatacgccgcagatatcatgaacttcgtaattttaacggctttgctttcggtcgccaactccggactgtatgcttccacccggatgctgtggtctcttgcgaatgaaaacatgatcagcgcccggttcaaaaaagtcacgccgaaaggcattccgctgaatgctctgctcgccagcatggccgtttcctgcatatccttgatctcaagcatcgccgccccgggcacggtctacgtggtgctcgtggcaatagccggatttgccggcgtcgtggtgtggatgagcatcgccctgtctcagctgttatttcgaaaacattatgtgaaaaacggcggacgcgtcgcggatctgaccttccgcacgccgttataccctctcgttccgatcgccgctgtgatcttatgtttcgcttcatgcgtaggccttgcatttgatcccaatcaaagaatcgccctcttctgcggaattccttgtatgatcctgtgctatctcattcgttttttgagaaagaaacagccgaaacaatccgtccgtgacattcatttggataaaaccatgccataaaaaaaaggcacatactgatgaggtatgtgccttttttgtcttattccgtaatcagcgtatgaatcagtttcggcgcttccgctttttctgagatgcggatgttgtcatagactttggcggtcacgtcgtcaacgttttcgcggttggcgtaaagggtgacgagcggctcgcctttttcgacgttgtcaccgacttttttgcggagcataataccgacggcaaggtcgatttcgtcctcttttgtcgcacgtcccgcgcctaacagcatcgctgcgacgccgatttcgtcagcgacgatttctgaaacgacacccgcttcttttgccggaacgtcaattttgtacgccgcctgcggaagtttggacggttcgtcaacgacggaagcgtctcctccctgattgctcaggaactctttgaacttttcaagcgctttgccgtttttcatgacttcctgaagcttcgttctcgcttcttccaatgtctcggcttttttcgccaatacaaccatttggctgccgagcgtgaggacgagttcgtttaagtcttcaggcccttcccctcttaacgtatcaatggcttcttgtacttccagggcattcccgatcgcaaaaccgagcggctgcgacatgtcagaaatcacggccatcgtctggcggccgacgttgtttccgatgcggaccattgctttggcgaggttcacggcgtcttcatccgttttcataaacgcgccggctcccgttttgacgtcaagcacgatggcatctgctccggcggcgatttttttactcataattgagcttgcgatcagcgggatggaattcaccgtacccgttacatcacgcagcgcatacagctttttatcggcaggggtcaagttcccgctttgtccgatgacggctaccttgtcgcggttcacaagcttgatgaattcatcttttgacaattccacgtggaagccttcgatcgcttccagcttatcaatggttccccccgtatgcccaaggccgcggccggacattttagcgacgggaacgccgagcgccgcgacgagcggagcgagtacgagagttgtcgtgtcgccgaccccgcccgtagagtgcttgtcgaccttaatgccttcaatggcggagagatcaatcgtttcccctgaattgaccatcgccattgtcagatcggcgcgctcctgatccgtcatatcctgaaagtaaatcgccatagccagcgcgcttgcctggtaatcagggatgcttccgtccgtgtatccttttacgaaaaattgaatttcttctgttgtcagttcttttccattttgtttttttacaataagatctaccattctcatgatctatcacctgtccttcatttatgttcagtgaatcaatccgacgatcgccgctgtcaggaagctgacgagcgttgcgccgtacagcagcttcagcccgaaccgcgcgacgacgtttccttgtttttcatgcagccctttcaccgcaccggtaatgattccgatagaggagaaattcgcgaatgagacaaggaatacagataccactgcctgtgtatgcgcgctgaaatggaaatcgccggatgagagcgtctgcatcgccacaaattcattcgataccattttcgtcgccataatgcttccggcgctcaccgcttcattccacggaataccggttaaaaacgcaaacggcgcgaatacatatccgagcagcgcctggaatgtaatgccgaagaccgcgttaaaaacgccgttgaccagggcaatgagtgcgacaaatccgatcagcatcgccgctacgacgacggcgactctgaatccatccattatatactcaccgagcacttcaaaaaaggattgcttttcttcttcaggaacgacgatcaaatcctcttctttgctgacggtgtacgggttgatgatagaagcgatgataaatccgccgaataagttcagcacaagcgccgtcacgacgtattcaggcttcagcatcatcatgtaagaaccgacgatcgacattgagaccgtcgacattgcggacgcgcaaagcgtgtataagcgctgttcagtaagatagccgagctgttttttcaaactgataaagacttctgattgccctaaaatcgcggatgcgacagcgttgtaagattcgattttccccattccgttcaccttgcttaacgcaagaccgatatacttcgtgatgaagggaaggaccttccaatgctgcagaattccgattaaagcggatataaagacgatcggcagaagcacgctcatgaagaacgtcgtctgtttcgcattcacaagcccgccgaatacaaagttaatcccttctgatgcatattccagcaagtagttaaatccttttgcaaaaccgccgacaagaaaattcccgataccggtgttgaggagaatataaccgagaatcagctgcagcacgagcatgacggcgatcggccggattctgattctttttttgccgttgctggcaagccaggcaagacctaaaaacacaatgattccgataattccgatgagatacttcatatgtgttctccttttatttgtattcgcttacaattttttatgcatcaacaaagaaagaggatggcggaagctttcggcttccgcaatgctgattaatagtcgctgctgccgctgtctccgccgctcacgatagagacgcccgcacttgcgccgatccggctcgcgcccgcagcgatcatgctgtcaacatcagcttttgttctgatgccgcctgatgctttgaccccgatgtccggtccgactgtttttctcatgagagcgatatcttcagccgttgccccgcctgtagaaaaaccggtagacgttttgacgaaatcggcgcctgcggataccgccaagcggcatgcacgctctttttcttcatctgtcaaaaggcatgtttcgatgatcactttgacgagcgcttttttatcagctgcttcaactaccgcgcggatatcagcttcaaccgcttcatcatcgccgtcttttaatgcgccgatattgatgaccatgtcaacctcagtggctccttttgagatggcatccttcgtttcaaatgcttttgtttccgatgtcgttgcgccgagaggaaatccgataacggtgcaaacgtcaactcccgtgcctttcagttcctccgctgcgagtttgacccaagtcgggttcacacaaacggaagcgaatttatattcttttgcttcttttatcagttgtaaaatatccgctttttgtgtatgcggtttcaaagcagtatggtctatttgacttgcaattgacattgtatgcacttcctttttcctaggatacgtttagaataaccgaattttgaacatatgtaaattggtaattgaaattatgttcatgaattgtcacaattcttgaatgagttttttggccgtatgctgatcagtaatcaaaacgttggcgtactttcctttcagggcaccgtgaatggccttgcattttctgctgccgcccgccaccagaatcgaacgctctttcaatttcaggtcgctaagctcaactccgatcgtcctgccgttaatgctgctgctgcaaatcctgccttcctcgtcaaaaaagcgcgaacaaatatcgccgactccgcgtgctttcagcaattgtttctcttcttcccggaaatagccgagtctgaaaagcagcgcctcatcccggacggttccgaccgtaaacagggcgatattggcttgtctgcccatttcaatgatccgcttaatatgtctgtcccgctcgaccatctgtttcacatcggcgctgtcaaatataaccggcagcggcaaatacctcggcatggtctgaaatgcttcggcgaacagctgaatcgtttctgacgaatacgtattgacattggaatgactgatgccgcctttcagctgcacgacttcaacgctctttacctgcttcggctccatgcggcttgcgatctggtacatcgtcgtcccccagcttacgccgagtatatcgccgtcctttacggttttatgcatatagtctgcgccatagcggcttaagtaatgtgtaatggcctggtaatcgtcgcttggagaaaagacgacgtgcgcctcaagcagcccgtatttttcttccagcttcgcgccgagttcatccagatcctcaaacgggtccatgacgcgaatttgcacataccctttttcctttgcgtactgaagcagccttgaaacggtggggcgtgacagattaagccgttcggcgatctgctgctggctgtaatctgattgataatatagttttgccgcttctatgctgagctgctgtttttcacgatccatgtcgcgcctcccctctccgcttatcatatcaccaaaacacgccgtaaaaaagcaccctctgatggggtgcctattttttcagcacaagctcctgaatcgcatgcgccacgccatgttcgttatttgatttcgtttcataatcagcaatctcccttacttccgggatggcattggccattgccacaccgcatccggcccactgaatcatggacatgtcgttgccgttatcgccgattgccatgacgtctttctgttcaatgccgagtttttcggccagcagcttgaccgcgtttcctttactgactttcgggtgaagaatctcatggaagaatggcgcgcttttgaccattgtgtatgtttccctgaatgattccggaatggaagcgatcgctttctccagcttgtccggatcgtcaatgaacatgactttcggaatcagaatatccttcggcacttcatcgatcgtgcggaaatgaagcggcacttttgtaatgtatgattcgtataccgtgtattcactgatatcccggttcggcgtgtacagattggctgtgtcaaagtaatgcatcggagtatccaactgtaagctcagctcgtaaagcgactccaaatcttcaaagcctaatgactgctcggccacgacaccatttgtatacgtattttggacgagtgcgccgttataggcaatcacaaagtctccttcttcctgtaagttcagctcttccaaataccgacgcacgccgccgatcggccggcccgtgcacaggacgatattgaccccttccgctttggcggcatcaagcgccccgcggacttcagccgtcacttcatgatgatcgtttaatagtgttccgtccatatctattgcgattaacttgtacatcctgcatctcctttgtatccttttctgcttatgctttcatcatatcgttttttcgtttcaatgaaaaatcaaacggacaagtttctccgccttctcttcgtataccgggcctgcctccggatgcggggccgtcttttccccttgtcagcttgttcgccgccgtcatctgttttctgcttcaagagcatcagccccgccgcaaagaaagggacggccgctatgtccagaagggcaagctttattcccatcgctgcgggaaagtatgcccataatgaacggctgttccgcctgatcatgatataagaaacgatttccagcaggataaacagagcgttcacccacaagtaaatgagcatcgccgcaaacagaaacagcaggagcgtattccgcagcgtgccggaaaacagaagagcgcgcatcatatcaaaaaatgaaaaagactgcatgctgccgttgacgacattgggattataaatggtaaaacgcccgaactgatcaaaaagcataaaaaataaccataacagtgaaaaccattgaatgatatgtacgatgacacccgtcaaaacgagtctgtcggcagccttatttctcatgtgcatcctccccgccggtttttattcttgtcattgtttttgtttctccgtatatcttccaaatgagcgtatcgttttttcctcttttcaacgtgcttttgacggggtgcggatgtccgaggtattcaatctcgatcgttccgtccgtgttttgtgagaccaccttgtaaacatctgagggcatgggaacctcgccgcggcctttaatgacctgctttgtcagcacgctgtctttcgtaaacgtgacggtttcagatctgaccccgtccatagggcccggtttcagccccgcatcccatgtcccgtaataaaaagggggttcgtctgctttcttttgcgagcagcctgttatcatgacgcatccgataacaagaaccgtcatgatgaaaatccgtatgttccgcaacatgatcaccttcttttgaagctttttttacgcctgtaagttaggcggatgccgtggcactgtgcaattgactacatagtgtataaagacttcactagataaggagaatgatgaatgaacccatatcagtactacaccccatctgcctatttccctcagcagcaggaatacgaagtgagccccgttgagtatgagccgtatcagcagcaggaaagctattattatgcgccccctcagtctgaagagcggcagccgacggctttagaacggagagtcgcccagcttgaaagacaaaacgcccagcaaacgagagagctcacccgcctctcacaagaagaccagcgccaaaaccgggaaatcacgcgtatgaatgagcagatcagacggctgagccagtccattgaaatccatacccgccgcttaaaccgtttgaatcagcgcctgcgcgcagtcgaaaacagactcaatattccttttcacgctacagaaggcggcttctgagaaaaagggccggaatacaaagctcgacaggccatcccgagccttgtattccgctctgtacataacaggtaaatatttgaatccttttcttgcatgaatgcctctcctattctttcacatgataaatgtgtaaaatcaatcacttcaggaggtcttcatgatgtatcaaaaccaatacagcggaaatcagctgcagcaatgccgtcaaacagcacagcagcttattcagcagacacagcaaagcagtcagcagtacaagcaaatgctccagcaggaacagcaaaacattcaaatgcttcagcagatgcttaaccatgaacagcatgccgttcataccattcagcaagcgctgcaggggcatgaagcggccattcagaaatgccagcaaatcgtgaatgtgtgcaatcagcttcagcaggaagtaagcggacacatgcctgcaccgatggcaaacgctaatgtttcttcattcccgcaaacacagcatcacacaccgtttcagcagcattcataccagcaataggccggtcatgcaaatgacaaagcgcgagataccggctttgtcatttgtttttatctctgttttgtcagatcaatgcgttgagcgggttttccgccgaatttttcctccgcctcatgccttaccgcttcaaacgctcttgcttcgacgttttgtttaaacacatcaagctgtattaaataagccgcccgcactttcagcccgtggatgatggagatgacccataaaggcagcacgatatacacgcccggcgtgctcggcagcacaaaagcaattgctaaaataataaaatagataagtccgtatttcagccattttttgttcttggcccggtagccgatatagaaaaaggccaagaaagcggtcagcccaaacggcgcgaaagtcagcagcagccaccagctgtgcagcacttcccaccaagtccctcttttcgtaatcaacattcattcctcctcctttactactataacatggataatcaaggaaggttttctataaaaaacatagacggaatgacgtcttcctgctatattaataatgataatcattatcactgaaatagggggatcattatgaagaaacaatcatggctgatcggcctggcacttctgcttgttttcgcattaagcgcttgcagcggcgcgaaggaaaacaacggatcggcatcaggcaaaggaaagacagacatgcgtacatatgaatcaacaaaaggaaatattgacatacccgcacatccgaaacggatcgtcactgacttttatgcgggtgagctgctgtccgttgacgcaaatgtcgtcggggcgggctcatgggctttcaaaaatccgtttatcaaaaaacagctgaaaaacaccacggacatcggcaatcccgtcaatgtggagaaagtgatgcagctgaagcctgatttaatcgtgctgatgaaggatgaccaatacgagaaactatcgaaaatcgcaccgacgattgtcattccttttaacaccgcaaagaatacgaaagatacggtcagcctattcggtgacattgccggggcgaaggataaagccaaaagctttatggcagacttcaacaaaaaggcagaagccgatcaaaagcgcctcaaaaacgtgatcggcaaagacgagacagtcggcctttatgaaacgacggataaaggcgaaatctggattttcaatgacaattccggccgcggcggccaagccgtttataacgcgctcggattgaaagcgccggccaaaatcgaaaaagacatcatgaaaacgggcgccatgaaacaggtttcccaagaggtcatccctcaatatgcggctgattatatgttcattaccgattacaatccgaatggagaaagcaaaacatttgagcgtctgaaagagtcatccgtttggaaaaatctcgatgccgtaaaggacaaccgtgtctttatcaacgatttcaacaccttctatccgtatgacccgattgccgtcagcaaacagatggatatcatcaccgacatgctgatcaaacgggctgaagaaaataaaaaataaaaaaagcggcacagtcatgacactgtgccgtttttcatgttcactttaattttgactgtacggatcccggcatatcttcaaatctgacttcttcccaggtctcgacatactttcctttcgccttcaccttcaaatacgcgtccttccgaaggtctttcccggcgaaaaaggtcacttcttcttttttcccggatgcgttatatccgtctaatgtatactcagtaccgcccgggctaagatgtttgccatctcgatcaatctgtacataaacatcttgctggtgaataaacggattaaatctgtctgtaacatcattatgaaaaaagagaagtccgtatatgacggcagcggccgccaagacggccaggattgccaatgcttttttcatctgtgcactccccttacttgttcatttttttcaaatagcttgtccgcaccgcgaggaagaacagaagctgaaagatgaaaaaccctccgatggtcagactgagcggccccgctacatcggaatagccttccaccgctaatgttctcaaagcaaacagcgtatgcatgacggcaatgacgaaaggaaagaaaaagagaatcgccaattgtatcgtcacgctttgtgccatttcacgctcactcagaccgattttggccaatgagcggtagcgctcccggtcctcatctaaatcggtgaacagcctgaaatataagaaactcgctgccgcgacaaagaaaacgatcgcgataaacaggccgatgaataaactcaggctcggcagctgcaccgtatcatagtacgtcccggcttttgccataaaatcagaatgcacatcgatatagttgccgtaaatctcatttttcaaggattggctgatcccaagactgtctttccaatgatcatagctgtagccgtataatgacgctttctcaccgagtgatttcagctgatcaaaggtttgatcgttcaccgcgatgatggcattcaatgaaatcagcggttttttgacttcttttaccgtcagtttttggtcagacggctttgctttttggttcagcagcttcagctgatccggcgcgtcgtttttgaaattgcggtcatacgtgcccgggaaatagacagcctcattatgtttcagcccgttcagcttgacatggaagtatgttgacacatccgattcgctgatcatgtaaacaggcggaacagtatctccttcctgatagcggacataggaaacatctattttgtctttcttatacgtaaagccgtgtgttttcagttcatggtcaatatctttcaaatgagtctgttctttcgggttattgctgaaagataaatactccatctcataggcggactcttccgccccgacggtcgatttgtacatcgcgagcacgcccgtcgccgtaaaggcaaccgcggaaataatactgacgataaagaacaggcgggcgttgtcttttaaacgatagacaaggtcagaaacccaaataacatttttcccgcgcagataaaaggttttccacttcttcagcgcacgcagaatccagatgctgctttggctgaaaaagaaatacgtgccgatgacggtaagcagtaaaatgatgaacggctcggtcccgtggacattgcctttcagaaccatgccgtacccgccgcacaggcaggcgatgccgaataaggacagaagcacggacggcttcggctccggcttgatcttgtcagtgccctttattaatttgatcaccgtatttgatctgacaaaaaggatcgtgaactgcgataaaaggaaaaataagagcagaaatccgccggccgtaatgccgagcgctttccaaggcatgtacagaggcagcgcgtccatttctaaaatataggcgccgaccgtaaagaacgttttcgaaaaaatgaagcctccgataatccccgctgcgatcgacatgacgccgatgatcatgttttccgccgtaatgagctttctcagctgcaccggcgtaataccctgcatcagcagaataccgaattctttatttctcgatttcaaaaatgcgttaaccgaatacagaacaaataagaaagaaaaaacaaagatcatccattccgcggcggttaagccttttttggcgatgttattcaggtagccttcctttagtgccggatgaaacaggaacatcgcaaaggtaaagaaaatcaaaacggaaaaggcgctgctcaagaagaatgcaagataggcccttttgtttctcgtgacgtttttataagcgaactgaagaaaggtcatttgcgtttccccccagcatagacagcacatcaagaatctgctcataaaagacttggcggttttccccgcggtaaatctcattaaacagttcgccgtcttttataaagatgacgcggcggcagtagcttgccgcaaccggatcgtgggtcaccatcaaagccgtgacatgatcatcctgattcaggctctgcatcgtttccatgacgtcttttgacgctttggaatcaaggtttcccgtcggttcatcggccagaataagtgacggcttatgaatgaccgctcttgcgatggcggcccgctggcgctgtccgccggatacttcaaacgtccgtttattgagcaggtcttcgattccgagctttttcgcgatgccgtgcagtttttcttccatgacagacggcgcttctttttcaagcgttaacggcagcatgatattttcaccgattgtcagcgtgtccagaaggttgaaatcctgaaacacaaatccgagctgcttgcggcggaaatgagcgagctttgtccgcttcagccggtgcgggttttctccgtgaatcaggatatcgcctgaatccggccggtcgatcgttgaaatgatattcaaaagtgttgtttttccggagccggacggtcccatcaccgccgtgaacccgccttcttctattgaaaatgaaatttgttttaaagcttgataggatacttgtcctttataggttttatttatatgtttgacttcaagcatattcgccatgagaatcctccttatggttttattcttgttgatctgggctgctttcatgtagtgccggggcattcagcataaaaaatccccttgacgtaaatccatgttatcaaggggaaacagaatgagctatgttgttttcttaacgcagtcttacatttttgtaagaaatgaaaatcggaccgatgtcccttcaccgggggacgagctgatgtccaccgtatgattgagcttgcccgtaatttctttgacgagatggaggccgattcccgtagattcttggaaacgccgcccgttttcgccggtgtaataagggtcaaacacccgcttgatatcttgcgagggaatgccgacaccgtaatctttgacttcaagcatcgtcctgtcttcatcgcggaagacattcagctccagtctgtcactcttgcctgccgaatatttgaccgcatttgtgacgacttggccgatcgcaaatttgagccatttggcatcggtgtaaatctgatgatcatcgcgaatatccattttcggatagacgcggtattgaataaaaaatcgtttatagctttgaatgaccgattggagaagctctgataaggaaaccgcttcgactttaaaatcccgctcaaacaggtcaagccttgatgaataaaggagcgtctccagcccgaattcaatctgccggacctcttttttgatttgttcaaagacgggctcatcctcttcctgaatgattaaattaatgaccgacagcggcgtttttacttggtgcacccattgattcatatacgtcacccgcgcgtcgagcttggcttcggtctcgtagagcttctggtgctgcagccgggtcagctccatctgcttttcatacagctctgaacagaacactgaagaaccgagatacgggatgtccgtcccttcctgctccgagctgagccaatgatacacaccgcggtctttgtaccagcgataggcaagataccccgccaaaataagaagctgcacgcccaatatgtaaaacaggtgggaaaaagaatgaagacccgcaaaccagtaataaaagaagacaaacagcccttgaaggagaaaaagcagaatcagcacggcatgagaccggagaaacagcttcatgacagcgccctcagctggtagccttcgccccgcaccgattcaatggaaacaggcgcgttcagctcccgcagtttttttctgagccgcgtgatatacacgttaagcgtattatcatcgacgaaaatgtcggtgtcccacgttttttccatgagccggtctcttcccgtcaccttttctccccgctccagcagcacttccaaaagcttgctttcttttttagaaagctcgcttttttcgtcctgaaagcgcagttcaaaccgttccacaaagagctgcacaccggcatattcaaccactttctctccctgcttggcggcgtactctccgtatgccctgcggatctggcttttgattttcgccagcacaatatcgtaagaaaacggtttttcgatataatcatctccgccgttttcaatcgccatcacctgatccatttccccgcttctggcagagataaaaatgatcgggcttgtagaatgctggcggatctggcggcaccaataatagccgtcataagacggcaggttgatatcaagcagcaccacatcaggcttttcccgcaaaaagacatcaagaacagccgtgaaatccgcggcggccacggtttgatatccgtatttttcaaggtaattctgcaatagtccgcgaatgtcttcactatcttccacaatcatgattttattcatgcaaccatcctccaaaaggatacggcttttcggagccatcattatttgatgcccccatcataatgctttcatcgcttctctgcaacatgagaaagcgggcctttataaaagacccgcttcaccctttctcaacgtaagatagattatttctaattgacattgttatacttagatggcggattcggaaaggtaattttaaatcttgtgccaactcccggctgactgtatatatcaatatttccaccatgcgccttgataatttgctgagcaatagccattcctaatccagtcccggagttatttgacgaagcgcttatccctctgaaataccgatcaaataaacattcaaccgtctcttcgtccattcctatcccatcgtcttctattgtaatttgtatttcgttgtcatgtaacacgtcctgatataatatgacctttattttagtgcccggaggattatgtttaatacaattagcaatcaagttttcaactgcgcgctttaggtacctttcatccatattaaaaagtatcttattgtgactggattctaaagcgaatctcttattttctgactccggtagcaacttcattttttctaaagtgtcatgaattactttcactacatttttttcttcaagatggattggcagcgactcatttttcaattgaaaagttaagttgaaatcttcaatcagcttttccatatattcgacacgttcttccattattaaggaaaaatcacgcacttgctgattttcccactcatattcatttgaagataaaagaaccgtatatcccttaataaccgaaagaggggtttttaaatcatgtgagacaccggccatccactcttctcgtgtcttttccaataattctctttcagccttattcctttgaagcgttgaggtaagttcagacagagcctgcattaattcttgataggtcttatatccagatttaatatgtttatatttgcttgaatgaaacttccgatcataaggttcttcatatttttctttagacaaattctcaatccaagatacaataaacagcaggggagcacctagttttttcccgtaaaatattgcaattacaatccctgccataatgatagaaacaatccacaagttattcacccaatagaaaaaagggttatttttttccatcggctttcccaatacccatgttaaatcatggttgtttttcgtttcgtaccacgtagataattgataaccttttttggcagggtacatgtaatctgatattaactctccaagaatataatgcttaggtatatttttaggtttattaaaagaaaaaacctcatctccttgttcatctaaaatttgaatccacatccggttctctaataaatcttcttttgctttcgtgtttattgaaaattgtttatctccaacaactgtttgggcaacaatttttttcaaggataagtgtggggtttccattttattttgacctaagacgaggctgaaaaatatgatactgcccaccatgagcagaccccaaataaacatgagtaaaaaaagtctcgatacgaagtaaaatgctatcctatttctcagcttcacaataaatcctcatctataggctctgcttcaaatatatagccctgtcctcgaattgtttttatccatcttggtctgctcgggtcttcctctaatttttcacgtaatcgtcttacatgtaccattacagtactatctccgccataaaactccccccatacatctttataaatttggtgtttacttaaaatttgattgggatgttcacagaaataaatcagaagtttcatttcctgagcagggcaatcgattcttgtcccgttaacaacaagtcttccggtattgggatctattttaaagtattcataatcgtatacctgttttagagggtaagaagaagagagctgagtcgttctctttaattgggcttttacacgagctacgatttccagtggattaaatggtttagtaatatagtcatctcccccaaaactaaacccttgcaatttatctaaatctgttgtttttgctgttaagaagagtatcggcacatttgtatgggagcgtattttgctgcataaggtgaagccatcagtgtccggaagcatgacatctaataaaataatatttggaagttcctgatcgattttcagaagggtttcgctccctgtcatagctgtggaaatattgctgaaaccttccttttcaaagcaagttattaataagtttaagatatgttcgtcatcatccaccatgaggattttgttctcttctaaagtcataagttatcctcctttttatttcttattttatatgagatcaaggacataaaggtcagaaaaggaaagaatttaactttcgttaagagttcagaatattcttttaatattttaaccttgatattcagggatcaatataactacatacagaaaataaacaatggatgtcgttaagtgaatgtttaggaagagtttcgtttgtgtttaaagaacatcgcttatgataaaagtgaggtgagagacaaatgaatgatcaaatagtggtaacacacgatctaactaaaaagtataaaaagcatacttcagttgatggattaaacttaaggattaggcgcggcgaaatttatggttttcttggaccgaatggtgctggtaaaacaacaaccatccgaatgttattaggtttaattaaaccaacaaaaggaaacatcgaaatctttggccaaaacctaaacaagaatcgtttgcagatattgcaaagaatcgggtcactggtagaatctccaacttattatggtaatttaaccggttacgaaaacttagaagctgttaggaggttacgaggacttccggaacaacgggtcaatgaagtattggaaactgtaaggttatctaaagtagcaaatcgactgactaaggagtattcccttggaatgaaacaacgtttgggaattgcagttgccctgttaagcagtcctgatttattaattctggatgaaccgacaaacggtttagatccatccggtatccaagaaataagagagttaattaaagaattgcctaaatcgggaatgagtgtcgttgtatccagccacctgttgagtgaaatagatcaaatggctactcaagtggggattataaacaatgggaggatgattttccaggactcaattgcaagtttacatcaaaaacgaaaaccactattaaaagtcggtgttagtgacgtaatcgaagcaaaaacaatactaaacaggaaaggattaaaggttgatttacaaaaaaattatttgtggctgtctcaaacagaaccggaatttgtttcagaaatcaattccatacttcttcattcagggctgtctgtatttcgacttgaagaaaagactcgatcgcttgaggatatttttttagaattaactggtacagagggaagtctatgaaaaagttattatgggcagatcaattaaaactgaaacgttcgtcgttattgattgtagtcttattggttcccttactcattatagcatacgagttggtgaatcttacttatcgatctgaatacgtggaaaaacaagctgaaatgttccatgctggatcaatgtggatgtatttactgtatgataacagtttgttatttggtctgggttttccattagccgccacactttctgcgtcaataatagcaaatatagagcatcaagcaaacggatggaagcaaaccctttcttttcccgtatctagaatgcgaatttatgtaagtaaatttatttgcttagtagtcagtttatttatttcgtcaacaatcttcttgctcggcatggtactgctgggcaaactggtaggattcgaaggcagtgtaccttggggacttttgtttggagatagttacagcatgttagttacagtactgcctataatggcattccagatatggttatctatggtgtttagcaaccaagcattctcaattcttgtaggatcagtatcatctataatgggtttgtttttggctgctgctcaatcaacgagatggtttccgctggcttatcctagtcaatcttcgacagtcattctgcagtatgaaggtataggatataacccagatctttcatcttacctttgcattagccttttcttagggataattatattatttctaggctctattcattttgctaaacgggatgctttgtaaaaaggaggcgaaatacttgaaaaacattttatttgtagaacgtttaaagcttaggcgatcaaagttatggatcatctatttactagggcctttgttaggtgtatccctggcatacactaactttattaaaaactataacctttttatgaatcctggagacaatccctgggtagaggcttggacacaagtggccttatttatgggcccttttgtattgcctatcgtagtgggaattttcgccgcccttgtttgcaggggggaacatgtaggaggcggttggaaacagcttctagccttaccagttaaacactcagatatctttctgggaaagtttctaacagtggtccgcatgatattcattagtatgttcattttaatcctcttatttattggattcggttatatgttaggcataagcgggagtcttcctttacttacaattctaggatatggaattagagggatcttagcttgtttaccattaattttattgcagcttattgtttcaatcaggtctaaaacatttggcataccactcgctgttagcattgtttttacattaccggccattattattgccagtacaccattaggtcaagtatatccatggacacagcctatgttagcaatgtcacccgcagatgaatcaccgattcaatcaaatttcctgttttactcaattatggtaataacctgcctcgttctcttggtttacggaataagaagttttactaaacgagaccttacgtagggtatatacggtctaaacttatgagaattcgagacaaggtaaactaatttgactagcgctatgtaaaacagaaatttatatgaaggtaagactaaatctttttggttgtattctttgaaactaaacgactaatggaaaaggtgatgtttcaaggcataagacataagaaatataaagatatcttaagactctttatttaaacattttttacatttaataatatctcttccatttttttgattatgagttaatataatactatacttaataaggggggtgaatacaatgagtcaagaagctatcattcgttcatggaaagatcctttttcccgtgaaaattctacacaaaatccagctggtaacccattcagtgagctgaaagaagcacaaatggataagttagtaggtgcgggagacatggaagcagcatgtacttttacattgcctggtggcggcggtgtttgtactctaacttctgaatgtatttgctaatttgatttatataggctgtttcccttcagaaggaacagcctatattttattatataaaatattagaaaattcttaaaaaacaggagggtaaatcgttggggaaaactctcgtttgttcagaaaatagctatttccaagcatatatgaatcatttattaacgccagatagtaatgaaataataaatgttaacacattggatgaattaaaacaaataatacccaaggaaaatttttcctctgtaatcatcgatacttgccaccctaatgatttagtgttgcaactgataaaatcgatatcttgcccagtcataatacttaactccttagaaactaacgtttcagattataaccctggtccaatattaaatcaaataaataatgtttcaaccctaaaacataatgtttttcaattgtcttttacaacttttttcgacgttggaaagcattgtatttggaaaaagaatgaatatatccctctggcaatacaagaatttaaaattttatatttgctctatttaaattcaaataaaatagtctgttctgaagaacttattgaatacgctgaccttactggtaggtcaagtctctatgtacacattagttctcttagagaaaaagtagaggataatcctggagatccaaagattcttcaaacaaagtttggaaaagggtacctcctatctgacagtacatatatttgtcttgaaaaaaaagcagactcaaaaaatgttgtgtaaaaaggatgacccaaaaatcattttaaaatgacttttgagtcatcccatttatgttagtgaggggtgttttgttctttctctaaaccctttttctattgctaataaagctttgtcgggtgtaattagaccacgattaggttttcttgtacccgtcgcgatctcaaacgccataatttcaactgggtcaataacaatatgcccatcttttcttaattgttcaatattcctggaaacaactgttttattccacattaaatcgttcatattagggaagaaaatagtgttatgtggatgagctaatacagtagttgcaactaaattcattgctacaccattagcagtttgtcctaagatgttcgctgtagctggaataatgcaatatatgtccgcccagcggccaatttctacgtggctatgtctttttccgttttccccatgttctgagtatacatggtcacaaaaataagaaacagtatgagctggaataaggtcttccgctgtttttgtcataacaacccttgtttccttaaagaaacttttaaaatataagagatacgaggagatgccgacagatgagattgatccgcaaatcccgatcaataactttttatcttttaatattgaaatactcattttttctcctcctgtgaattttaaactatcatactacacaattattctttttgtggtgtttatttcaaatattaaatattcttaataaacacatataaaataaacctaaacttcttttgaaattcttttaacttttaaataaccctgctatatttatggataattaaggaatcttaattgttcaaatttattaaaaatgaggtgttcaatatgcatacaaaattaaaatggaattcggtatggaatagatcttcttcgataagtgaaagaaaagtaaggcgtccacttaatactaattgggatgaactaacaaacagacgattcgaaagatggaaaagccttgttgaaagtgatgaggggattcgaattgagaatgtattagccacccaaaatattgatgaagaaactctaaagcatactatcaatgcaaaagaagtggaatttattaatgaaagtgatcatctaggatggctagaaattattcagctagttgatgaacaatcctataaagatgtaaatatagaagttagaaaagatattctcttctttagttttataaaaccatttttgaaaatagcaagaggcaaattagaggaagtattatattctcactctaataaatctctgataaaggaagaacttagtccgtctgtaattgatgattcacttaatattcttggtgaaactttgtcagctataagtagtcggatattaatattggagttaaatgtagcaagggtagcaggaaagctccgaggtgaaacttctgaagaacgagcctcttatttcaataaagtccttttaaatgacccggcatatgttcgatcaattcgagaagaatacatagttttaacaagactgttagcaacaaaaacaatgtattggattcaaaatacttctgaactccttataagatttcatcaggataaagggctattagaatctgagtttagtaatggtcaaaaattaggaaaagttatttccatcgatacaggaagtagcgtctcagatactcataacaaaggaaaaacagtcgccattttaaactttgagactggaattaaaattgtgtataaacctcgttccttagaaatagacgtaaaattcaataagtttgtaaattatctaaatggtaaaaatttaagttttgacttaaaaactgttcacacacttaacaaaaaatcttatggatggacgcagtttatctcttataaagaatgtcaggaagaactgcaaattggaaaattttattggcgtattggaagttatttagctatcttatatgcaatgaatgcggtagattttcatatgcaaaatttaattgctgagggagaatatcctattttagttgatttagaatctttatttcataataattctacgtatacagataccagtgcttttagtcgcgcacaagaacatattgaacgttcagttttgcggattgggttattaccgagaaaaataaatagtaaagctggatttgaaggaattgaccttagtgcattaggtgcacaagaaggacaagtatctccgcataaaaccagtacaatagttgatcgagataaagatacggtcaggatagaagaaaaaaactttccaattccagttagtcaacatagacctatgctgcatgggcaaatcattaatagtgttgcttacgaaggagatattataaaaggatttgaagaaacctacttccttttcatgaaatataaacaagacatgctcgaacaaatagattcttttaaaggggttactgtaagacaaatattgcgtggtacatctcgctatgcaaaccttctgaaaataagtttacatccagatttcatgagagacggcttagatcgtgaaatgattttagataaattgtggttagataccaaattgaatccacgattgaaccaagttgtaaatagtgaaaaagacgacttattccttggggatatcccatatttcacaagcaagcctgaatctacaaatatgtgggattccaacggtcgaaaaatcaacaatttttttaaaacaagtgccttaaatgagacaaaggaaaaaataaatgaaatgaatgaaagtgactgtcatgaacaagtaagctttataaaaacagctattttagtaattaaggattcttatcgtaaacataaagtatttgatataaatcctcgattacacgtatttaacccaaaagatttttttcaagaagctattaaaattggagactttcttgctagtagggcgattgaaggtgaacagttagatggacaagaggatgtatcttggattggatcgtttgttgacaatcaacgagaggatcaattcaagatttcagctgcaaatagttcattatacgagggtgtaggaggtatttctctcttccttgcttatttaggtcgcctctctaacgatgaaaaatacaccaaactatctaaaaaagctttagtggcagtacacaaaaatatgtctgcatctagtgatttgggtgcctttggggggattgcttcttacctttatttgttggatcatttatcaaaattatggaatgatgaacaactattgaaaaacgaacttcattctgccctcaacaaattagattctttgatcgaaagggatgaaaacaacgatattttaacaggggtggctggaacagcagttattttaataaatttgtttaaacggtataaagaagaacaaatcttaaacttgattacaaaatgcggaaatcgtcttattcaaaatattaacgttatggaaaagggagttggatggaaagtcccggcaaacccaacgccagcctccgggtttgctcatggtgcctcaggaattatatgggctctttatgaaatttacgcaattactgagcaaactgtatttaaagaggtagctgaaaaagcattagaatttgaaagaactttgtttattccggaaaaaaacaattgggcagatattaaacttgaaaacggacagtttcgaaatgataattttgttgcttggtgtaatggcgcatcaggcataggattaggcagaatattgatcctgccacacaatcaaaatgaattgataaaggatgaagcacatgtcgcaattaatacaaccctaaaatatggttttgaacatgatcattctttatgccatggtgatttaggtaatctggacatccttatgtacgcagcggaaaactttaataaaaagttaagcgtaaatgtaacagaactaagccataaaattttaaatgatataaagctcagaggatggttaactggatttgaaaaaaataacgaatccccatccttaatgatggggtatgcaggtataggacttggattgcttaagatttttgcaccgactgaagtgccatcagttttgagactccaatcacctttagaactaaaattgtaaaattaaaatgagccttactttgttaaggctctatttcttaggagtgatccaatgagaagaagagttcctctagtaaggcaaatgggacaatatgagtgcgggcccgcctgcctcaccatgattttaagttactatgggagtactatatctctaaataaaataagtgaacaatgtgatgctcaaagaaatggcgtatctgtatccattttaaaatcagtatcagaatactatgggcttaactgcaaagtataccaagtttcatttaaagatttgaaaaaatatatccattcatatcttccctgcatcatattttgggatgaacggcactttgtggttttagaacagattaaaaaaggtctttttcatataattgaccccaacagaggaaagttgagattatccgaagaagaatttaaaagacattatagcaaggtaatcttgacttttacgaagtcagatagatttaaagagatgatgccatcacccgcagcaaagtattatttacgttatatagttaaaagccgtactattgtttcacttatcattctcttttcactgatcacacaagtagtcttcttagccgttccttttttaattaaatatttagtggatcattctttaataagtaaatcaacaaattcttttctatttttaggaattgtagtcatcatagcagtttttatattgggacttgttatgtttatccgcaattatttcacaattaaacttcaagctattataagtaaaagcatttcaaacgattttgtggaacatttattaaaattacctcttaatttttatgaaaatcgaacaaccggtgatattgcaatgagagtaagtaacatttccattataagggagattatggctaagaatggagcaacagtagtactagatattattactttgatttcattttttattgctatgttaactcaatcatttaagcttgcattttttgctattggattggcaattattcaattcttactaatgatgattttgattccaagaataaaaaatttaatccataatgacttatcaattcaaacaactacacaaagttttttggtggaagctctaagagctatcacttttattaaatcaaatggtttagatcattctatcctaacaaagtggtcaaattactatgataaacaaatcgaagcattttcacagcgataccacttagacgctataatggatagcataagtataagcatccgatattgtgcaccccttctcttattatggtttggatcaaaagaagttatcaccggaaatttaacactcggaggcttattagggtttagcagtttaggaacatctttcttgttgccgattgcttctttaataacaagcatgcaacaatttcaattggtcggtgacacttttgaacgaatgcaagatgttatggaaactgagcccgaacaactcaaccaaacttcaataattgaaactgaactatcaaaacaggacataaaacttgaaaatgtcacatttacgcaccagagcttacatattcttaaagaagtttcattaaacattaagtcaggtactaaattagctctggtaggccgtacaggtagtggaaagacaactttatcaagaattatactggggttatacaaacccactaagggaaaagtattatatggtgaagaagacttgaagaatttaaacctttacgagctccgaaaacaaatgggggtcgtattacaagaaagctttcttttcaatgatactattgcaaacaatatagctggatttaaaagcttatctcaagataaaattgaacaagcagcaaagagagtgcagttacacgaagatataataagaatgccaatgggatataacacaattatcggggaaaatggcagtatgttgtcaggagggcagcgtcagcgcatagcaatagcaagagctatcgtcgataacccttctgtagtcattttagatgaaataacaagtaacttggatacattaacagagcataaaattgacgaatactttgcaaaatcaaatattacccgtattgtaataactcatcgtcttttaagcagccaagactctgatttaatagtggtattagatcaaggaaaaatagtcgaaaaaggaaaacatcaagagttattagagaaaaagggatattattatgacttatggataaaacaagtaggggatagacagaaagctacgctggaaaagccctttttcctcaatgagcccactggaaaaactttgggccgctgactttattttatttcaataacgcgtgctataccctttatcttcatgttcgcagactacaatttgaaagactgaaacaaaacaagccagagcaatcccccatttagaaaaaatcttgccgctgtcgaacataaccatgtgtttatcaatgactttgacaccatctacctttaccaatcgctttcagtcagcaacaggttgatttgattgtgatactttggtgaaacgcaagaacgaaataaccggaaagacgaaagcactcacgatgttgtgagtgctttttcttcagccgacctgctgttttacggctttaccggctgatccgaactctctcattttgcttcgcaccgtctcttccacggcttcaatgccgggtgtcaaatagccgcgcggttcgtacagatcgccgttttcctgaaacatgcggcgtgtttcgtctgtccaggctaccatacattccgtgttgatattgattttcgcgtggccgagcgtgatggcttttttgatctgatcctgaggaatcccggatgctccgtggagaacgaggggaatatcagtcatgcgggagatagccgccatttctttaaatccgagattcggctcgccctgatatttgccgtggacggagccgagggcggcggccagcgcgtcgatattggtttcttgcacgatccgctcacattcggcgatatcggcatagcgtaccccaccgaccagcccgtcttccatgccgccgaccgtgccgacttcggcttctactgagacgccgtgctttgcggcataatcggtgacttcttttgtcatcgcgatattctcgtcaatcggctgatgggagccgtcaatcatcactgagctgaatccggcgtcaatggcctgtctgcagcgttccgcactgcttccgtgatcaagatggagcacgacgggaacggtaatcgccatttcttccattaacgcgccgaccatggcggaaatcgttttaaatccgcctaaatagccgaccagacgatcggaagccgcggcgatgaccggcgattgctccttttgcgccgcttgcagaatcgccttcgtccattggaggccgttgatattaaattggccgactgcataatgctcccgtttcgcttctgcaagaagatgtttcatggtgacaaaagccatgttcacgcctccttcatgaagtattttgatacgacggcttccgttgtttcctttgccgttttgatcgtttcctccgcagtcagcttataatattcaggtctgaacagctctacggagacaacatcattgaatccgatttcttttaacgctgacagatgggcgtctaagtcaatcgcaccctgcccaggccagacgcggtcttcatccgttaaaaagccgatcggaaagtcttctgtatcgtcgatatgatagatgaaaattttctttccgtccgcctgcttcaagctctcaatattggagcccatcgcgtggaaatggaagctgtcaaacaccagtccgacattatcgcggccgacagcgttcacgatgtcatacgcctgttcaaatgtattgaccgtgcattgcgggtggccgacaaattcaagggcaatgtttacgccgtacggctccgcgatgtccgaaagctcagtcagcacctctatgctgctctttttgatttcttctttcaagattttccgctctgtcacaagcggcacggccaccacatatttcacgccgagcgtcctgcaggtttccatcatgcttttgaattccgaaatgatctccctataacccttctcatcacgattgttgaagaaaaccagggcgttcagggcaagcggtttaatgtgatgggattgaaaatattccgccagatcggccagtgaatggtcttttaagtattccggcagcttatccattgtgcggatttcaatataatcatagccgtgcttttcgcacagttctaaatcctgtttcaggtttgaattctccagcgtagtcgcttcattaaagcaaagtttcatgtcagcctctcccatccgcgttttcgatatgaagggagtccggctgaagggcttttttgccccgctccgccgaactccatactcagcttatgccatacccagttcttcttttaatttcttaagcatgatccggcttgattcatccgctctttcgccgacccaagcaaacacggcgttcgtcgcaattccgtcgaatttcatctctctcatctttctgaaaatcgtctcaaaatcgacctcgccttgcccgatgtccagatgctggtgaaccgttactttcgcatcaggcggattgacgatgtaacgcaggccgtgcgccgctttatgattaaaagtatctgcaaataaaacatgtgtgaggcggtcgccggcttcatcaaacatggtttcgatatcgcctttgccgtcatcatagaagaacgtatgcgcagtcgagtagacaagattgatccaatccttatcgagcgcgcggatcatatccatcgcacctttgtgcgtttcgataaaatcgtatggatgggcttgaagattgagtttaacgccttctttttcaaagacgggcagcagctcatccatggatttgatgaatttttcttcacttgtcaacggatcatactttgaaccgctgaattcactgttcatcaaatccacttcaagttcaaccgcaatttcgatcgcccgtttccagttgcgcacggcggcctggcggcggtcttcatcaggacccgcccagtggtaaagcggaagaagggaggacagcttcacacctgtatcctttaaaaggcgcttcaattgtttgatttttgctgaatcgactttcggatatttatagaaaggacaaaaatcctcgcgcggggacagttcgatatattcgtatccgagttccgccgttttatagaccatttcctctaatgttaaatcatcgcggtacatggatggatctaaggccagtttcattttttcactcccgatctattatttgttcacagtcgtaaatgattgatagaatgccggtttctcttgcagcgccactggctctttctgtccggattcctgagcttttacgcacgcgtctgttgtcaccgcggcaatataaccgtcccatgccgtcggaccgctgacttcgcctttcttccggatcgaatcaatgaagtcctgaatttccacatcatacgcagccgcaaatcggcgctgccagtccatcagaatatcggtgctgaattttccttcttttctcaagctgatgcttgacggttccggaagcttaatgacgccgtcttccccgacgacttcacattgaatgtcatagccgtatttacagttcacatagatttctgcattgatgacgatgccgccttttgtttcgatgatgaccatctgcggatctttcagatgcggcagcgcattttttgatttcttcggatagatgacttgtacggattcatagtcgtcattgacaagccagtggaggacatcaatttcatgaacgagcgtatcgacgacggccatgtccgttgaataattcgatgcgactgtcgggttgcggtgcgcacagtgaatcatcagcggctcgccgaccgcacggttgtcgatcgcttctttcagctgaacgtaaccgctgtcatatctgcgcatgaaacctacctgcaccaatcgttttcccgtcttcatttcttcctcgacaatgcgcatacagccttctgccgttgtcgcaagcggcttttcacaaaacacgtgcttgccgtgctgaatcgctttcaacacgctggattcgtgagccgggccccagcttgtcactaagacggcatccacattttcagcagcgagaaggctgtcgtcatcaggataaaccgaggcgttcaaattgaaatgctgaacggtctgctgcgcggcctcctgattcacatctgtgacagcggtaatttccgcgcccgacagcttatttgtgatgcggttgatgtgctcttttccgatagcaccggttccgataacacctatacgtaaattcattgatcgccactccttctgataatcaaataatggttctcgtctttcttttctctctgccgtcctgaggagcaccgtacagttcctcctgtatctgttcaagcgacttgccggacgtattcggtgcgaagacaagcccgatgatcatactggccgtcacacatatgagcagaataccggccataaaaccgatgccgaattgtgacatgatgaccggcacaaataaactccaaatgccgattgaaatacggacgagaaagaacatgagcccttgtgctgacgctctgtgttctgtcgggaacagctcgcttgcccacagctggtagttcgcctgctggccggctccgttattgatgccgatcgctaaaacaaacaaaagcagcatcgggagcccctgaaacggcagcaaaaacagcgaccagccgacaacagccataaaggcgcagattccgaacaccgttttccgatattgatctgcaaaaggcatgaagatacaggcgacgccgagcccggtgaagataaacagggccatctgcagaatgttggccgtatttgcggatacgccgccgacctgctggtagatgtacggcatgaagaatcccatgacgcccgcggcgagattccatacgagaaacacacccattaaaaacaaaatgttcttgaaaaatttcggctgaagcaagtcaaaataagatgtttttttcacggcggcaggccgctcttcactgtttttccaggcatccgactcaggtaaacgctttcttatcacatatgtgatcagggcgatcaccaatagatgcgcaaagacaattttatttcctaaaagcccgaggtcaccgaccaaaacggataacagcagaaccacaacggctccggcggcccacgccacctgcgccactccgcaatgcctcgcccggtttttttcgggggcgttttccgcgataatggtccatgaagccgtaatatccgcgcctacagaaatcccgataatcatgtatccgcataacagcatgggaaagttgaatccaaacaaaaccaaacaaattcctaaagcgtacacgagcatactgtttgtgtatacagcttttcggccgaccttatcagccaaatacccgccgagcagcgctccgatggccgctgatatcgcgtttgcgctgaaggcgccgagcaatccgatctgactgtcggacagcttcaagtagctgacccacatagataaacccgctgatcctgccacgatggaacctgcatcaatgtaatttgctaatgctgcggcgatggtccgtttgctgaaagctgattccgccttggcactattcatataagtccccctctaatttgcaggatcaagcagttcactgtcgatgtactttctcgcaatcagcgcgtactcaagcggattggcgactgccgggtcttgttcggcttcaatgacgatccagcctgaataatcatgacggacgagcgtttggtacacttcggtaaaatcgatgcatccgtctccgggcaccgtaaaaatgccctgtaaaaacgactgcctgaatgacttgccttcctgtctgcaccgctccataatgtcaaaccgcgcgtccttgaaatgaacgtgtctgatccgatccatatgcttgttgagaatcgtcatatagtctccgtctgagatataggcatggccggtatcataaagtaaatggacataccgcgggtccgttccatccatcagccggtcaacttcttccgccgtctggacgcctgtgccgagatgatgatgaaacgtgagctccagcccgtattcgtcagcgattttcccgagacggttcaagccttggcacagtgtatcccattcttcatttgagaagtgcggttttttcttaaatacatcaatatccaagccctggacactgtacgtctgttcagaaacgatggcggcatccgctccgactttctgcaaataatcacagtgttctgtaaattgttcagccgttttttcaataccgtcttgaatgataaagctgctgaaccatttccccgcaatccgcaagttccggagagccagctccttattgaggacggagggttcagggaaaaaccctcccacttccgtaccttgaaaaccggcgacaacaatatcgcttaacaaatgctgcagcgtattcccggctccgatctccggcatatcgtcattgcgccacccaatgggagcgatgccccacaaaatattttgtttgcccatcgtgatgcctcccctctagtactgcttcgcagacttcagcttcatctctttcgcttcgtatgcccgctgaacgctttcctgctcagacacttccgccacgccgacatgccaccagctgtcatagccgtccgtcatcgttttcggcagaaccttcatttcaattaaagtggatacctcttgcgttttcgcatcttcaagcgccgctttcagttcttcaaccgtattggctctgtatgttttagcgccgtagccctctgccaccttcgcgtaatcaacgtttaaaatctgattgtcctctgtgcggaactcgcagaaataactgccgctcccgtgatccatctgcaggttgttgatacagccgaacccggagttgtcaaagagcaggacattgatttttttgttatattgaagcgcggtaatcagctctgagtgcagcatcagaaagcttccgtcgccgacgagtgaatagacttctttgtcgggatgagccagcttgaggccgagcgtgcccgatacttcatatcccatgcaggaatagccgtactccagatggtacgtattcgggacgttggaatgccacagccgctgcagatcgcccggaagagatcccgccgaactgatgacgacgctgtcttcaggaatcgtgtcgttgatggtcaacagcgccgttgtttgcggcagctcagtctcgagcgcgtcggcatactcgtttaacacgtcctgtgagaaatggtttttaatttccggcttgaacgcgtcacgtgtaaaagtgaccttgccgagccggtcccgttcagccagccattcatctttccagcctttaatcgccgtgccgaatgcacttttatatccgtctaataagccgtgcagcctgccgagcgtcactttcgcatcggctacgacctgaaacgcgtcaagtttgtatgcctgcatgcggctgacattgatattcaaaaattttgctttgtcaaaatcaaacgccgttttcgaggatgtcgcaaagtccgtgtaccgtgtgccgacaccgatgatcagatcagcctggcgggcggctttgtttgcggcaagtgtgcccgtgatgcccatgccgcccagattgttggcaaaatcggcttcaaccgttgacttgccggcctgcgtttcgacaagcggaatgccgtatgtttcagaaagcgcgattaattcctcacgcgcgccggagtacttcgcgccgccgcccactaaaatgacgggacggctgctctccttaattctctccgcggcgcctttcagctcacgctcgctcggctgcatccgatcaatgtaatgaacacgtttttcaaagaagctttcatcaaaatcaaatgcttctccctctacatcctgagaaatgcagatggtcgccgggcccgcttttgccggatctgtcatcacttcaaatgcccggattaagctgctcatcagctgctcggggcgggtgatgcggtcccaatagcgggacacgggctttaacgcatcgtttgtcgtgacggcggcgctgtattcctgctccacctgctgaagcaccgggtcaggctgcctcgtcgcaaaggtatcggccggaagcagcagcaccgggatatgattggccagcgccgtacccgcggcagccgtcaagttagcggcacccggaccgaccgatgtcgataccgcgtaaatttttcttctcagcatctgcttgctgtatgccatcgcggcatgcgccatgccttgttcgtttttgccttgatagactttcaggtgcccggcgtcctgctcgagcgcctgcccgatccccaacacatttccatggccgaaaatcgtgaagatgccctcaacgaacggctcttcttttccgtcaacatgaatgtactgccggttcaagaattgaatcagcgcttgtgctgtcgttaagcgaattgtcttacccacaaacgatcccaccttttatacgttctatttaccgttaagactgtgctgcgcttcaatcagttcgatgatttcaccggcagccggcattgcttctgaggagctgtgtttgctgacgacgatggaagcggaagcgctcccgtattttaacgacgtttcaatatcccggccgctgaccagtccgtagatgaaagctgacgcataggaatcacccgctccgaaggtcttcagcacctttgttttataggcgtgcgcccggaaaacttctcccgatctgctgtatgcgtatgatccgtcaacgccgtgcttaatgacgacaaggtcggcggagtgcgcaaacaaatggcggacggtttcatcgttatttccgccgctgcggttttccattacgtcaaattcgtcacgcgtaccgatgacgatatcggattgttccgccgccagcgtgtagtacacggctgtttcttctgccgattgccatgtatacggacggtagtcgagctcaaacacgacttttacgtcatgtttttttgcgatttgcaccgcttttaagacggcttcgcgcgacgggcttttcgcaagcgccgtacctgatacgagcaacattttcgcgtttgcgatgtagccttcattgacttcggacggctctagatacaaatccgccacgtcatcccggtacatcagaatgctgcactcttcaggactgagaatttccgtaaaagcgagcccggctttgcgtccttctctgtcaacggtcatttgtgacgtatcgacgcccttttcctgcatataagaaacgataaatctgccgtgctggtcatccgggattttgccgataaaaccggcttttaatccgagcttagcgctgccgatcgcaatatttgccggggagccgccgacatatttagaaaacgtcatcgtttcttccatcggccggttgtattccgccgcgttcaaatcaatacacgcgcgtccgatcgcgacaatatcaaactctttttcttcattaaacgtatatttcatcgttatctgccactcctcacttgtcagcgttccagaatccattcatgggccggatcattatgaaacttccattttcgtgtcggtcccgccattacattcaggtagtaagaggtatacccgtccggaacaccaaccgggtgatagcccgccggcacgatgacaacgttttcattttctgcggtcatcgtctcgtcaatcgagcggtcgtccgtgtacacacgctggaagacaaatccctgcggcgggtccgtttcatggtaataggtttcttctaaaaatgattcagccggcagattgtcttggtcatgtttatgaggcgggtagctcgaccagttgccgctgtccgtgtaaacttcaacaacgagaaggctgtttgccgatggatctgaatcggggagaatgttatgaacggttcgtttgtttgccagcttgccgcgatgttccacaccgttgtcttccgctttaatcagcgttgtcggaagctggtgttcggacggagagtagcacagcgcgaccctcgccccgctgacggctgtgattccaaaagagcggtcattggacacataaacgctgtccgtcggttttctatcaaatacgctttcacgggtgccgatgctttcaaatgtctgatcataatcagtgacggtaacttttccagttaccgcaacgatgcagcactccgtctttttcaaatcttctgtataggttgagccgggagcgagatcaacgactttaaatccgacgtatttgaggtctgagttggctgaagtgacgtcatgtatgatggtcacgccttgagaaatttcatcggcctgcggtttgcgcagcaaatgactcatgtttattcctccttaatggatggtaaaagaaaacccggacggaatcacaaagccgtccgggccggctgtctgatcaattgaagtcaggagacgggtatcgtgccgtcacgacttttttacgtgtatagaagtcgacgctgtcttttccgtttgcgtgcaatgtgccgaagaaagaagacttccagcccgagaacgggaagaatgccatcggcgccgggacgccaaggttgatcccgagcattcccgcgtcaatattctcacggaagtagcggatcgcgttcgcatttgacgtgaacaggcaggcgccgttcgcaaattcagactggttggcgatgtcaaccgcttcttttaaatttttcacacgcatgaccgacagaacaggcgcaaagatttcatctttccagatcgtcatatccgtcgtcacgttgtcaaaaatcgtcggaccgacgaaatagccgtcttccgttacatgttcacggccgtcacaaagcagtttcgctccttcttcgatgcctttttcaatatagctgtgcgtacggtttttgttgtcctcgcggatgaccgggcccaagaacacgccgtcatccagtccgtttccgatcttgatgtctgcggccttttcctgtaatttcgccataaactcatcggcgattccctcttcaaccgtcacaaccgcgcatgccatgcagcgctctcctgccgaaccgaatgccgcgccgataatgtttgtgaccgtatcttcaaggtgggcgtcatttaacacgatcgtatggttttttgcgcccgttaacgcctgaacgcgtttcaaatgttcgctgccttttttgaaaacatactcgccgacaggttttgaaccgacgaatgagatggctttaatctccggatgctcaagaatgccgtttacgacgtcatgcgcgccgtgcacgacattgaagacgcccttcggcagaccggcctgttcaaacagctctgccagtttttccgttaacagcggcgtgcgctcagacggcttcagaataaaagtgtttcctaatgaaatcgccatcgggaacatccagcagggaaccatcatcgggaagttgaacggtgcgatgccgccgaccaccccgatcggatagcggtagttcgccgcctctacatctgtggcgatagaggcaagtgaatcgcccatcatgagtgacggcgcgcctgctgcgaattcgacgttttcaattccgcgtcccacttcaccgagtgcttctgtcgtgtttttaccgttttccaaagtgatcagacgggcaagctcttctttgttctgctggagaagctgctgatagttaaatagaattctcgcacggcgcggcactgccgtcttcgaccatgttttaaacgcttctgacgctgagcggacggcgtattccacatcctcccgcgtagaaatcggaacctggcacatcacttcttttgtagccggattgacaacgtcttcatattgatctgtcttactttcaacccattcaccattgatgtagtttttcagttttctgatctctgccattctcattgcctccttaaatagtaaacatcctgttcagctggataataacggatgaatatattcatcttttacatataaaagacatgaattaaacgcttacaaatgctaaaatgatggtgactcccaatctttccatgtaaaagttggtcatgtgccagataaagcaaacggttacatctttcacttttgattttacaggttatattttggtcatttcttggttacattgtaagcccaacacaccttcaagtcaatctaaaaaatcaaaattttttcattatttttatcatactttttttaagcgggaaaacaggaacttggagaaccgtgtcgaatcgtacggtgggaaccctcttttttatcatttgttaagtaactattgattaactcttggtgtttattatatattttaattactttaagaattctagaaggagtttttttatgaaactgatgcggattcaggagatggaagaatacattctcaaacacggagccacttcgctggatgagctgtgcgaggtattcaacgtctctaaaaacacggtcagacgcgatattaataagcttgcggaaaaaggggtgatcaaaaaggtgtacggcggcgtgacgtcagcagaaaaatctgtgctcgtcccttttgagaaccgcaccattcaacatcaggatgaaaaaatcaaaatcgcccgctatgcgtcgcggtttatcgaggatcacgatcttgtatttattgattccggcacgacgaccaaatcgatgctggagacgcttgacccggataagaatgtaacggtgttgacgaacagccttgatattattaacgccgcttcatccatgaaaaatatcgacctgatcatcatcggcaataactataaacggaagacaaggtcgtttgtcggcattgatgatccgagcacactcaataaatacaacattaacaaggcgttcatgtccgctaccgggacaacgatcacccacggcctgacgaattccgacttactggaatacgaggtgaaaaagaaaatttccgaaaaggcgaacgaagtgtatctgctcgcggatcattccaaattcggcaaatccacgcttttgacatacgcgcctttcgaccggcttcacagcatcgtcacttctcagcagctcgatgaggaatatacgaagtattgccaagagcaccaaatcgacattcacttggcatagcgttatagttaatagagaacgctgccgtattttcccggcaggcgctatgatatccaattttttcagggggcgaaaacatgagcaaagtaacaatcggcaaaactgacctaaaggtatttccgatcggtttgggaacaaatgcggtcggcggacacaatctctatccgaatctgaatgaagaaacgggaaaagaattggtccgggaagcgattaaaagcggcgttaccatgttagataccgcctatatttacggtgtgggccgttctgaagaattgatcggcgaggtgctgaaagaatataaccgcgaggatgtcttcatcgccacaaaagccgctcatagaaaagaaggcaatgactttgttttcgacaactcaccggcctttttgaaacaatcggttgaagacagcctgaaacggctgcagacggattacatcgatttattctacatccatttcccggatgagcatacaccgaaggacgaagccgttcaagcattgaatgagctgaaaaaagaaggaaaaatccgttccatcggcgtatccaatttctctttggagcagctgaaagaagctaataaagacggcttagtcgacgtgattcaaggagaatacaacctgctgaaccgtgaggcggaaaagactttcttcccttatacgacagaacacggcatctcattcattccgtacttcccgctcgtatccggactgctggccggcaaatacgacgagaacacaaccttcccggaaggcgacctgcgcaacgatcaggcgcatttccaaggggagcagtttaaagaaaacatcaaaaaagtcaaccagctcaaaccgattgctgaaaagcacaatgccgatacggcgcatatcgtgcttgcctggtacttggcgagacctgaaatcgatatcctgattccgggcgccaaacgcgcggatcaattaaaagacaacatgaaagcagcctccattacgctatctgctgaagaaatcgcgtttattgacaagctgttttcctaagaaaaaaaacacgcctttttgaaagggcgtgtttttttatgtttatatttttctcttcggggaatgaaatagttatctaaataaactattatgcgttccaaaagatgaggaggatcatctgtgaagaaaaacaccaaaaaatacctgatttactttttcggagcattgggcgggctgctttacggctatgacaccggtgtgatttcaggggctttgttatttattaacaatgatattcctttaaacacgctgaccgagggattggtcgtcagcatgctgctgctcggtgcgattttcgggtccgccttaagcgggacatgctctgaccgatggggccggagaaaagtggttttcgtcctttcactcatttttattatcggcgcgcttgcctgtgcggcttcgcaaaccgtcaccatgctgattatctcccgtgtcatactcgggttagccgtcggaggctcaacggcgctggttcccgtttatctatctgagatggcgccgacaaaaatacgcggaacgctcggcacattgaataacttaatgattgtaaccggaattttactcgcatatattgtgaattacatattcaccccgtttgaagcttggcgctggatggtcggtctcgcggcagtaccggcggcgcttttattaatcggaatcgcgtttatgccggaatctccgagatggctcgtcaaacgcggccgtgagcaggaagccagacaagtcatggaaatgactcacgacaaagaggatatcgccgttgaattggcggaaatgaaacaaggagaagccgagaaaaaagaatctacgctcggcttgctgaaagcaaaatggatccgccctatgctgctgatcgggatcggcctcgccatcttccagcaggcggtcgggatcaacacggtgatttactatgcgccgaccatctttacaaaggccggactcggcacttcggcgtccgttctcggcacgatgggcatcggtgtcttaaacgtcatcatgtgtatcaccgccatgatcttaattgaccggatcggccggaaaaaactgctgatgtggggaagtgtcggcattaccttgagcctggcgtcactatcagccattctccttctggccggcctgtcagcttcaacagcttggctgaccgtgctgtttctcggaatctatatcgtcttttatcaggcgacatggggtcccgtcgtatgggttctgatgccggagctgttcccgtcaaacgcacgcggagccgcaaccggatttacgacattgattctgtcggcaaccaacctgatcgtttcactggtattcccgcttatgctgagcgcaatgggcatcggctgggtgttcggaatattctcagtcatctgccttacatccttcttctttgccgcttacatcgttcctgaaacgaagggcaaaagtttagaagaaatcgaaacgcacttgaaaaaacggttctccttaaagaagcgcagcaaacaaaatcaaattcttaaacagcgcacactgtaataaaaaaaggaatcgccccgctgggcgattcctttttagcgtcataccataactttgcagatatcattcgtaaactcgaccggatcatggatcggcagcccttcaatcagaagcgcctgattgtacagcaggtttgtgtacaatgcaagcttttcccgatcttgtccgtgcgcgttctttaacgtctcaaacacttcgtgattcgggttgatttccagcactttttccgctttgacctgctgactgtcaggcatggcgtttaacactttctccatttcgatcgtcacttcgccgtctgtcgcaaagcagaccggatgagattttaagcgttttgaggctctgacattcttgactttatccgcaagaatctctttcatgcttgcgaacaggtctttatattcgttttcttcggcttcagtctgcttatcatcttcgtcactgtcgatgcctaagtcggcgcttgagacggatttgaactctttttcctcgtagcttgtcagcattttgatcgcgaattcatcaatatcttccgtgaaatataaaatttcgtagcctttgtccgccaccatttcagtttgcggcagcttttcaatccgctcatatgaatcgccggacgcgtaatagatatatttttgatcctcaggcattctggacacatattcgtccagagtgacgagctttttctccttagatgaatagaagagaagcagatcttttaagacgtctttattcgcgccgaaatcattatagacgccgaatttcagctgtctgccgaaagattcatagaaagattcgtatttttcccttttgttcttcagcaggctcttcagctcggctttgatttttttattgatgtttttcgcaatcagcttcagctggcggtcgtgctgcagcatctctctggaaatgttcagcgacagatcctcagaatccaccatgccttttacaaagctgaaatgatccggaagcaggtcggcgcatttgttcatgatcagcacgccgttggaatacagctccaatcctttttcgaattccttcgtataatagtcaaacggcatgttttccggaataaacaaaattgaattgtagcgcaccgctccatcgacgctgatatgcacgtgggtcagcggtttatcaaaaccgtaatgcttctcggcgtaaaaagcctcgtaatcctcatccgtcagctcgcttttgttttttctccagatcggcaccatgctgttgaccgtctgttcttcctgaacttcttcaaattcgttctcgctgccctctttcggcttgttgaccgtctcttccattttgatcgggtagcggataaaatcagagtactttttcacgatcgctttgatgcggtagttttctaaaaactcatcatagctctcatcttctgtgttttcttttattttcagggtgatttccgtaccgacggtttccttgtcacacggcgagatcgtgtagccggcggccccttccgactcccatacatacgcctcgtcactgccgagcgccttacttttcaccgtgactttatcagccaccataaacgccgcataaaacccgacgccgaactggccgataatgtcatggccgtctttcgagtcattttcttgcttgaaagcgagtgaaccgcttttcgcaatcgtgccgagattctgttcaagctcgtcttttgtcatcccgataccggtatctgtgacggtgagcgttctcgcttctttgtccgccgtcacttttatatagtaattgtcttgatcaaacgttaatgaatcatcggttaacgccttgtaatagattttgtcaatcgcatcgctcgcgttggaaattaactcgcggagaaaaatttccttctgcgtgtaaatggagttaatcatcatgtccagcaatcgcttggattctgctttaaacttttttttccgcacttcagatctctcctttaattatgctttgatgttatgtaaaatcttttcagcatctatttatcatatacagtgacaattgtcaactaggattagcagatgcatatattgtaaatttaacatgttaatggattcatttcacccattttatcaataaaaaagagagaatgttgatcatcctctcctctctgcttctttccggcggccgaattccttcttcatccatatgtatgacgggtagaaaaacaaactaaataagataagagatcccaagtttcgcaaagactcatgcagaacatttcttacagtgagaggaaacgtgatgtcctgaaacagaatagagataacggtgtaaatcacaaatcccataggaacaatggcataacaataaaacgctatctcctttttatgctgtatcttcaaaatatgtaaacctcccaatgatgtatatacataatatcaacatatttaataggtatttagaaacaaacctccgtatgtttatccccctattcagcgggaacagatatagaaaaaggaggaatcgcaatatgggaagattaacagacaaaaccgcaatcatcacaggggccgcgacaggcatcggacaagcgacggcacgggttttcgccgatgaaggcgcccgcgtgatctgcggtgacatcaatgaaagcgaactgaatgaaaccgtcagcgccatcagaaaaaacggcggagaagcagaagcctttcaccttgatgtatcagatgaagaaaacgtaaaatcttttgcagacggcattcagcaaaggtacggaacaattgatattctgtttaacaatgccggtgttgaccaagagggcggcaaagtccatgaatacccggtcgacctgtttgaccggatcatcgccgtcgatctgcgcggcacatttctgtgcagcaaatacctgattccgctcatgctcgaaaaaggaggctccatcatcaacacctcctccatgtccggccgggccgcagaccttgaccgttccggctataacgccgcaaaaggcggaatcacgaacctgacgagagcgatggccattgattacgccagaagcggaatccgcgtcaattccttatcgccgggtacaattgaaacgccgctcattgataaattggcaggcacgaaagaagacgaaatgggcgaggcgttccgtgaagccaacaaatggatcacgccgctcggccggctcggaaaaccggaagaaatggcggctgtcgcgctcttcctcgcttcagacgacagctcttacgtcacgggagaagacatcaccgcagacggcggcatcatggcatacacttggccggggaaaatgctgattgataagaagtggaaggaagagacggagtgacgatagataataaaaaaagccagtgtaaaaaaaacactggctgaacaagctgagggcgggttacttaaaccagcccttttcctttgatcgggtaatggcttcaattcgatttttcacttctagtttatccagaatcatcgaaacgtaattgcggactgtgccgcttttgatgctgagggcgtttgcgatttctttcgtgttttttccgtctgcgacaagctcgagcacctctttttcccgttcggtcagcgggttttcttcactataaatgtcctccattaattcaggtgcatagacgcgtctccctttcatgacgctgcggatggcgctgacgagctcatcgctcgggctgtccttgagcatgtacccgctgacgcctgcttttagcgcccgctgaaaatagccggagcgggcaaaggtcgtcaaaatgatgattttcacaccgctgtccttgagttcttctgccgcttcaagacctgatttcccaggcatttcgatatccatcagacagatgtcgggcgcatgttttcccacgaaatcgatggcatcctggccgcttgtgcctttgccgacaaccgtcatatcctcttctaaattcaacagcgaaccgagtgcgccgagcagcatttgctgatcctcggcaatgaagatgttgatcatctgctaccatccttttcttttgattttgaatcattcgggattctcatggtcagctttgttccggcggctgtatcgatggctaaactgccgtttgcgaattcaagacgttccctcattccaagcaggccgtgcccctttgaaaaaaagcggtcttctctgcattgaaagctgccgtcatcttctaccgtaatgacaacctctttccaaagctgctgaatggtgatgcggcatactttggcgccgctgtgtttcacgacattggtgacggcttctttaatgcacatgctgacgatgttttcgttcagcaaagagatatgtttgggcgcttctttttcttcatacacaaattcaattcctgccgcttcaagaatttgccgaacattgccgagctcatccttcaatcggatgcctttcatcgatgagacgatttgtctgacctcatttaaggaagtgcgggccgtctgctgcacgcttttcagctcagcgcgggcctgttcaggatccttatatatcagctttcgggcaaggtcgcttttcagtccgattaaggagagcttttgtccaagtgtatcgtgaaggtcccgggcgatgcgctgcctttcttccagcttcacaagatcggcaattcgctcatttgcatattctaatttctcctcaaggcgctcccgtgcctttctgcttcgaatgctgagcggaagcaggatggcactgatcagtgtaatgacgataaacggaatttgtgtcaaaaaccactcttttttcagaacaaggctgaagttgacggcaaccgccgcactgatgatatgaatgtaatataagatgtaaaatggaactttgtctcggatatggccgatgaagtaggcgataaagaaggcgaaataaatataactgaacagcatggctgagccggtcgaaatgccgatcagaagaagcgcccataagtaaagcggccagccttttgcaacaaatgcaaagcggtatgcgccaaagaaaacgagcgtgaaaatgatgccggccacgatgacaaaggtagaagagcttttaaaaataaaataaaaaggcaggatgaaaaaaatcgtccatatataaggagaaatcccgttcagtttttgaaatttaaaatacttcttcatctttgttccaccttctgctgcttgtgtctaccatcactttatcaaaacaccgccttcattgcaccctcacgcatgaagagaaggctctttctgataagagaaagagccgtgcgccgtatcaggcatttttctttaaaggttctttcggcaccggatggggcgccgaggttttccgcgcctcccggaaggtgacaaactgcttttcgtcctcatcccacagacggaatttcatggattcaagacttgttttaagcgtaatggtcggtacgttttttaaaggctcgtgtccctcatgagcggcttccagcttgtagttcggcactttcggacttaagtggtggacatgatggtagccgatattgcccgtcagccattgcaaaagcttcggcagcttgtaaaaggagcttccttctaccgcggcctgcacataatcccaatgctcatcggcttcaaaataagaatcctcaaacgtgtgctgaacataaaagagccagacgccgattgaccccgaaataaggaaaatcggaccctgaacaagcaaaaagttttcccagccgagaagcaggcacgtcgcagcagccaataagacaatcgccgcgttcgtgaaataggtgttccagcgctccttgcggcgggcgccttttacattgaaacggtttttaatcagaaatacgtaaatcgggccgagaataaacataataaacggattgcgataaagtctgtagcgtatttttgtccaggctgacgcttcgttgtattccttgacggtcatcatccaaatatcgccggtgccccgtttatctaagttgctgctcgtcgcatgatgaatggaatggcttcgctgccattgaaggaacggaaacagtgtcagcacacctgaaataaacccgaacagccggttcagcttcttttgtttgaaaaaggattggtggcagcagtcgtggaaaataataaagattcttgtcaaaaatcccgctgctataacagtacaggcgagggtcagaagataggagacattgaggctgaagtaagcaagaaaccaaagggcaaaaaacggcacaaacgtgttgaaaagctgaatgatactatgctttgtatcggcgccggaaaatgcggcaacctgcttttttaaagacgcttgtttttgagttgcggcgtgattgatcatgaatgtcatgtcccttctttttcattatgacctcaagtataacggggcgcccgacgcggttgtagtagcagccatcatgccccgaatatgacatttgtcatgtttggcggcagaatgctgatcaggcgtcatatggaaggtttctttcatatctgcacttctcaaagaaaacagcaaaaaagaacccggcctgttttcggccgagttctttttcatcatcctcacagcaaaatcacccgatacttcttcacatccaaaaactgcagaaactcccgggccagcatatccggcgcgtggtcttttccttcatgaagacgatattgaatcagaccgacgagcatggacgcgacatagtatgcatagagctttttgcccgcctgaatgtgcagaggctgatgaagataaaacgattgcagcgctctgaacatttccgggatgacgtcaggcactcctgaatcctctctcagaaaatgaacgagcggaaggccgccggacagcgccgaaaagagccggacgagcgcggcttccgcttcttccacggagcagtcggcagggtctccttttaccgtcaataatccgatcagatcccggcatgattgatggatgatcgttttcagcaatgcttctttgttggcgtaatggtcataaaaagtggcacggcggaggttgctttgacgggcaatatcggaaatcgtgatcgccgcgtactcttttgtttccgccattaagccgatcatggcttcttgcaaggcctgcctcgtccttgtcacccggcggtcggcgggctttttttcttcttgttccggcacccggcggccgaacagccagtaaaaccgtttttgagaaatcaaatcccacacctgtccgctgatttcttccggggatgccccgggctcctcattcagccagtacaacacaatggcatatgtgtataacgcgcggtaatgaatgtacatatcctgttcagtcggtgagaaatccgcattgaccggtgacagcagcacatcatgccggaacacatcttttaaaaaagcatgaacgtgaaaatacggcattttatgacggtccatcatcgtttgaaaaaacacccggtgccggtcaacaaaagacagtgtcggatgcactttttgccatccgccctgtaaatgaagcacatctttattcttcagcgaatcatacagcgcttcgctcagcccgtctttcatttcttcctctatatcctctaaaatcgcatatttatcttcgtaataaaggtacagtgtcccccggctcacgtgcgcccgttcggcgatgtccttcatggtcacacggcggatatcccgctctccaagcatggccaaaagcgcttgtttgatgtcatttgtcatagaatccggcataagagacactcctttcattagacagatcacggcaatttgtacggtaacgtatagatgcgtttacgctgtctttgccgcaaaaacacatcacattataataggccctgaagaaataaaaaagcaaccagaggaggaaaaccgatggatcagcatataaaagcagacatcaaacgcgtctttgcgcttcagaaaaaaaatcaaaaaacgctgcgtgcttcaacagccgggcagcgcagagaaaagcttcagcgctttttagatgccgtcaccgcacatgaagaagaaatcatcgaggcgatcagacgggacgtccgcaagccttatcatgaggtgaaaagagcggaaacgcagggaacgatcaaggcgattaaagataatatgaacaatctcgacacctggatggcgccgaaacgcgtcggctcatccgtcagccccgacgctgacggcgtattaatgtacgagccaaaaggccttaccttaattctcggcccatggaattatccgtttatgctgacgatggctccgcttgcggctgccattgcggcgggaaacagcgcgattgtgaagctgtccgattttacgatggagacgagccatatcgccgcgacagttattcgcgaggcatttcacgaagaagaagtcgccatttttgaaggtgaggtcgatgtcgcgacagaactgctcgaccagccgtttgaccacattttcttcaccggaagcacgaatgtcggtaaaatcgtcatgacggcagcggcgaagcatttgtcgtccgtcacgcttgagcttggcggaaagagcccgacgatcatcgacagcggctatgatttgatggacgcggcgaaaaaaatcgccgtcggcaaatttgtcaatgcggggcaaacatgtatcgcccctgactatctccttatgaaggaagatgtacaggacacctttacagatcttctgcagaccattgtcaatgcaggttttatggaggatgatcatacggttgaccgcaacaaattcacgcagattgtcaatgaccgcaactttaaccgtgtcaaagccctgtatgatgatgccattgaaaaaggggcaaaaacggcgttcggcggcgtattcgatgctcatgaccgcacgatttctccgaccgtgctgacaaacgtcacgcctgatatgaagatcatgcaggaagaaatcttcgcaccgattctgccgattatgaattacgaagatatcagtgaagccgttgattacatcactgaacgggacaagccgcttgccttgtatgtattcagccataatcaggagctgatcgattatgttctgcagcatacgacgtccggcaatgcttctgtcaatgatgtcgtcgttcatttcactgacgtcaaccttccgttcggcggtgtcaatacgagcgggatcggttcatatcacggtgtgtacggttttaaagaattctctcatgaaaaaggcgtattcattcaagcctctaaataaaaaaaagaatccgcgtgcgcggattcttttttattatttttttgccccgaatgcgagcagtttcgtataagtgccgacataaagcgtgccgtcttcagccagaaccggggaggaaatgacattgctgtctgtttgatagcgccatttttcattcccctcagcgtcaaccgcatagacgtttttatcgtcagaaccgaagtacacattgccgtccgcatcaatcagcggcgccgttctcacaggcccgtccgtatagaaagaccagttcatattaccggttttgctgatggaaaacagctcgccgcttcccgaaccgatatacacattgccgttatggtcgattgctaatgaagagctggagaaaccgtttaacgggaacgtccactttacagcacccgttgatgtataggcgtataagttgccgtcctggtttccggcgtaaacggtgccgtctctatcaataaccggataacctttaaacccgttggacgtcgtttttgaccatttcacttggcccgttccggaattgatcgcgtaaaagatattattgtacgttgccgtatacagagtgccgtttgatgctaacacgggagcggagccgaccacgccgtttgttttaaatttccacttttgcgtccatgtcgaaggcgacgtcggtttaatcgcatagatatagttatccagcgtcgacacatacagcgtgccgtcagagccgatagccgcatcggaactcggcgctccgctcagcggaaccgatgttaaaatgtttccggtttctttgtcgatgaaatacagttttttatcgtgagaaggaagataaatgacaccgtttgttccgagcaccggagtcagcgtataggtcgtcccgaggttttccgtcacccatttcacagtaccgtccggatgatacgccgtcagcttcccgtcttttgattgaataaatacggtgccgtccccgtcaaccgcggctcccgcaccgttttgaggggtggccggaacattcttttcccattttaacgcgccatcggcagtgcttgtaaaccggctttcccttgaccagttgaacatcgtcggagacatcgcctgcgcgtcataccgtcccgccaagaaaccggatgccgcatgattttgtttaaataccgtttccgcggcttgagcagccgccggatgcagccattttgcccccggcagatcagaaaccgcccccacagataaagccgcagcaaccgcagcgccggccgccaatgttttcattcgcaatgaagctgtcttttttttcaatgtcagttcctcccgtttctattaaaaactgctataccactttcatcataccataatcatcctatgaaatatttgtattttcggtagatttatagaacaaatgtcacatagcctgctgatgcttcggggaggatcgaaacgcggcaatataccacaccacattgacgatgaaagccgcgcctgaccaaacgaaaaggccgtaataaagagacagctcctgccctaaggaaattgcggtcaataacgccaccaacaagacagccgcgcaaatgataagcccgattccgcaaaaaacagccatgatgattttcatgccacgaacaccgagaatatacataatgagcgggaccgcatatataacaaggatctgaccgacggcggcccacatgcccgcggaattaaaacgattcgcgttcggccccgtttctgcaagcggagaaagcgagacgaggaccggcaataaacaaaacatcagagcggaaagcaaggtcaccgcaaccgcaccttttttcttttgattcatgtgaatatcctcctgacaataacccggcttttttaccggtaatctgatgatatgttatattttagcacgatatttacttaatttgagaatgttttgccaaaaacgaatttacaaatccagaaaaatagatataataaacgttatggaaccgatattgattcataaagcgttatctaacaaaacacgaagtgatattatgacgtggcttaaacacccggaagaccattttgatgaaagaccttatcttgatcagggactcagtttccgcaccggaatttgcgtcggtgatattcaggcaaagtcagggcttgcgcagtccgtcatctccagctacctgctgacgatgcaaaaagccggcctgctggaatccgaacgaatcggaaaatggacctattacagaagaaatgaaaaacaaattaaagcctttgctgactatgtccagcaccagctataaccatggaaggagggcttttttcgttctaacatatctatttttctatatatgtagttataaaaggaggcatacataacaatgaaaaaaagcagttccatcttcattctatttttggcattaggggttttcggaattattacgaccgagatgggcatcatcggggttcttccgcaagtggcggacagatttcatatttctgcttcaaaagcgggatggcttgtcagtattttcgcgttcatcgtcgctgtgtcgggaccgtttttgaccttgcttgcttcaggtataaaccggaaatacattctgcttttagcggtgctgatgtttgccgtttcaaatgcggtctacgcgtatacggcgcatttcagtgtcatgctggcgtttcggatcattccggctttatgccacccggtgttcttttctgtagcgcttgcggccgcggcccggcttgtccccgccggccaatccggaaaagccgtaacgaaagtcttttcaggcatcaccgccggctttgcgttcggcgtgcctttcacgtcttatctggcggatcgtctctctcttgaagccgccttcttattcggcgctatcatcagtctcatcgcgttcacgggcattcttctctttttgccatccatgccggtcacagaaaaaatgtctttcagtagccagctcggcattcttcgcaaaccggctttgtggctcaatatcgctgccgtcacctgtctctttgcggccatgttttctgtctacagctattttgcggagtacctcgggcgggtgtcccatatgatcggcacatgggtcagcttcatgctgatgagtttcggggtgattatgatagccgggaatttcgtcttcggtgctttgttatataaaaatatgaaaaagaccgtcatcctgtttccgcttctttatacagccgcctacttgctcatatacgggtttgggacgtctttcgcgccgatggccgtcctcgtcttcgtatggggcgccgttcattccggcggtctcattgtcagccagacatggcttactgcggaagcaaaggaggcgcccgaattcggcaacagcctgtttgtctccttttccaacctcggcatcaccatcggaacggcggcgggcggctggtttatttcacatttgggaatccatcagctgatgtggtgcggcatcatgtttgcccttctggctttcgggctgatcatgggacgcttggcatggggaaagaggctgctcgcagaagcttaagctccattgcaaaatccggaatgattacgtataatattccagattaaagcaagggagagaaaaagatacatggaaagaccggcaggattttggattcggtttctggcttacgtcattgatcaaatcatcataggaattccgatttttatcattcaatttatggtctcttttttatttgcggcaggcgttgcggcggctgaccccttcatgaccgaaaaccagtttaacatctcttttctggtgttcggcgtcattccgattcttgtgagctctattgtgatcagcatcttatatttcagcctgctcacagcctcaaagatgcaggggaccctgggaaaagcattgctcggccttaaggtcgtcaatgaagatggcggacgcatttccatcggccaggccttcggacgcgctttcgcctatatcatatccaagctcattctttatatcggattcatcatgggtgccttcggagagaaaaaaacgctgcacgacatcatgtgcagcacccgggttgtttataaataatgtccccaagtccgggccttttgagcccgggcttttttatgacggctgtgcccgcctgatgtcaatgctgccttctccgtcagcctcaatgcggatcgtcccgttcacaatgacagacagcggatggaactccgcatgctgatcagaaaaaatccagcggcggccgctcggccctaaaagcaaaaacgccccatcattgtaatcacccataaaatgaaacccgttttccttaagaggcgcgccgtctctcaccggtataccgaaacgctgcagctccttccccgtcgataccacctcggcagccgtcagattcacctcaccgatattcagaacggactcaatcgaaaaacgttccgcgcttggcggcgatgtgcctctcgcgatgaattccgccagattgttggacggatctttaaaataaaaggaacgcgcctgaatatgggagaaatacacctcatcctccccatcttccgtttgaaaaacgactttatcctttatccacgccttcgcctcatcaaaacgattattcggaatgttaaacgcaaaatgatacgtcggttgagagtgagaatcggcgcgcctgaattccaactcactttctcccgccttgatggtaaacgaatcaccggactcatcaattaaaggaaaacctaacacccgttcatagaagtgtttcgtctcctccaacgcacaactgtacaaagtaatgtgatttatttgcatgatcataccccctttggtttatactgccatatagaggggttgattcctactgtttcgattcaccaattgagaatccccctttcgcccggcgctacacatgacaaacagcgccaaaccgcttataccaggcgttattaaatgtctaaagcaaaaaaagcagaaaataataccccatatagcttgacaaaaaataaatgttatttaataatctatatataattagaattattattgaaagataaagtgaatgctttgtctttttaatatatttcaaatcacatttcaggaggaagatattatgtctttaatcggaaaagaagtactgccattcgaagcaaaagctttcaaaaacggtgaattcatcgatgtaacaaacgaagatttgaaaggtcaatggagcgttttctgcttctacccagcggatttctctttcgtttgcccgactgaacttgaagatcttcaaggacaatacgctgcactgaaagaattaggtgttgaagtatactctgtttctacagatactcacttcgtacacaaaggctggcatgacagctctgaaaaaatcggcaaaatcacttacgcaatgatcggtgacccatctcaaacgatctcccgcaacttcgacgttcttgacgaagaaactggtcttgctgaccgcggaacattcatcatcgatcctgatggcgttatccaaacagttgaaatcaatgcaggcggtatcggccgtgacgcaagcaacctagtaaacaaagtaaaagcagctcaatacgttcgtcaaaacccaggtgaagtctgcccggctaaatgggaagaaggcggcgaaacacttacacctagccttgatttggtaggtaaaatctaaggagtgcattccattggtacttgatgcaaatatcaaagcacaattaaatcaatacatgcagctaattgagaacgacattgttctcaaagtaagcgccggtgacgatgacatttctaaggacatgctggctctcgttgacgaactggcttccatgtcatctaaaatttcagttgaaaaaactgaattaaacagaacaccgagcttcagcgttaatcgtaccggagaagacacaggcgttacattcgccggtgttcctctcggccacgaatttacatcattagtgctggcattgcttcaagtcagcggcagagcgcctaaggctgatcaaaaggtcattgaccagattaagaacatcagcggagaataccgctttgagtcttatatcagcctgacgtgccacaactgccctgatgtcgtccaagcattaaacatgatgagtgtgctcaacccgaatatcacacatacaatgattgacggcgcggcattcaaagaagaagtagaaagcaaaaacatcatggctgttccgactgttttcttaaacggtgaatctttcggaagcggccgtatgaccatcgaagagattctcgcgaaaatgggcagcggcgcagatgcgtctgagtttgccgacaaagagccgtttgacgttcttgttgtcggcggcggacctgccggcgcaagcgcggcgatctacacggcgcgtaaaggcatccgcaccggtgtcgtcgctgaacgcttcggcggccaggtactcgacaccatgagcatcgaaaacttcatcagcgtcaaagcgactgaaggaccgaagctcgctgcaagccttgaagagcacgtgaaagattatgatattgacgtcatgaaccttcagcgcgcgaaacgccttgagaaaaaagacctcttcgaacttgaacttgaaaacggcgctgtactgaaaagtaaaacagtgatcctttcaacaggtgcccgctggcgcaatgtcaacgtacctggtgagcaagagttcaaaaacaaaggtgttgcatactgcccgcactgtgacggaccattatttgaaggcaaagacgtagccgttatcggcggcggaaactccggaatcgaagcggcgattgaccttgcaggtatcgtcaatcacgtgactgtgctggagttcgcgcctgaactgaaagcagacgaagtcctgcaaaaacgtctttacagcctgccgaacgtcactgtgcacaaaaatgcacaaacgaaagaaatcacaggcgaccaaaacgtaaacggcattacgttcgttgaccgtgaaacaggcgaagaaaaacacgttgaactccaaggtgtattcgtccaaatcggtctcgtgcctaatacagaatggttagacgaaaccgtcgaacgcaaccgcatcggcgaaatcatcgtcgataagagcggcgcgacaagcgttcccggcctatttgccgcaggggactgcacagacggcccgtacaaccaaatcattatctccatgggatcaggtgcaactgccgctttaggcgcatttgattatttgatccggaattaatgtaaaaagcgctaccctgcttacacggcaggatagcgctttttttatattaaaacggcatactgcatggcagtacaccgtctgaagtcattcaatctgtctttctccctctcgcccgatagataagaaacaatccaataaaccacagcggcgtcagcagcaaagccgggcgcgtcgcatccgcaaacagcataatcaccagaatgaaggcaaacagcgccagcacggcgtaattgataaacggcgcaaacggcgccttgaaagacgagcttgcatgtaagtccggacgggttttcctgtatctgatatgacagacaagaatcacgccccacacccaaatgaaacagatcgcgctgatggttgtcacgatgccaaaggccgcttccggtatcaatttgcttaaaagagcgcccgctgacagcacaataaccgatatccataacgcgcggctcggcacatgatttttattcagcttcgcaaaacttgccggcgcctgtttcgttttgcttaagttatacagaatccggcttgttgaaaacatcccgctgttacaagcagaagcggcagacgttaatacgacaaaattaatgattcccgcggctaacggaatgccgaccagactgaaggtctttacaaaaggactttccgttgcattcagctgcatccacgggttaatacataaaagaatgatcaatgccccgacgtagaaaaataaaatccgcaatggaattttattgatcgcggacggaatattttttttcggatttgacgtttccgccgccgacacacccactaattccacaccgacataggcgaagatcaccatctggaatgaaagcaaaaagcctgaaaatccgttcgggaacaagccgccgtgctcccacagattcgccgctgaaaccgttccggtatgcgttttgaacccaatcaccagcagaaccaccccgatgacaattaacgcgagaatcgtgactaccttaattaaggcgaaccaaaactccaattctccaaaaatcttaaccgttaacagattaagccctaataaaatgagcaaacagataagtgccggaatccactgcggaatatcaaaccaatatttcacatacacaccgaccgcgatcacatccgccatagccgtcataatccagcaaaaccagtaggtccagcctgtgacaaacgctgcacgcggtcctaaatacgcctcggctatatccgttaatgattggtaccccgctttagataacagcagttctcccagcgccctcatgacgaaaaaaagcgcaatacctacaataaaatacgcaaagatgatagaaggacccgccagctgaatcgccttaccggaccctaaaaacaatccggtaccgatcgtgccgccaatagcaatcagctgcacgtgccgattcgataagtccctctttagctctcgctgctccacatctgactcctccttacctctctagtgaacgatgagcaaaaaaagccaataaaaaaagagattggatgccctccaatctcatggtcataagaatatcaaattatatttgcgccgctgacaatcaacagcatgacaaatacatattcggtactcttctgtccttttgcctgagattgtgaacccttcggcgccgcggaaaacccgcggtctctccagaagccgctcctgctgtagtgcgacccacagcaatcatagcctgctacgtattgagtttccgatagaaataactatcagctaactttttattttaatggaagttgaatgcattgtcaacaggggtatgcgctcacagcgttatcccggtccaattttcgatgcctgaagcgccgtatcttccgttttcattgtctcaaaaaggcgttatgcggtactatcatataaggtctaatcatttaaacattatgtcatactttaaattcactttatcatacaattgctcgtaaataaaaaggggatggacgagattggaaaccaaatatttagatctgctcgcacaaaaatacgattgtgaagaaaaagtggtcacggaaatcattaatctgaaagcgatactgaacctgccgaaaggaaccgagcatttcgtcagtgatctgcacggggagtaccaggcattccagcacgtgctgcggaacggttcaggaagagtaaaagagaagatccgcgatattttcagcggcgtcatttacgatagagaaattgatgaattggcggctttggtctattacccggaagacaaactgaagctgatcaaacatggctttgatacgaaagaggcattaaacgagtggtataaagaaacgattcatcggatgattaagctcgtttcttattgttcttccaagtacacccgctccaaattgcgcaaagcactgcccgcccaatttgcttatatttccgaagagctgctgtacaaaacagaacaagccgccaacaaggaacaatactactccgaaatcatagaacagatcattgcgctcggccaggccgataagctgatcaccggtcttgcctacagcacgcagcgattggtggtcgaccatctgcatgttgtcggcgatatttacgaccgcggaccgcagccggataaaatcatggaagaactgatcaactatcattcagtggatattcaatggggaaatcatgatgttctctggataggcgcttattccggctcaaaagtatgcctggcaaacattatccgcatctgtgcccgctatgacaatctggacattattgaagacgtttacggcatcaatctgagaccgctattgaaccttgccgaaaaatattacgatgataacccgtctttccgcccgaaagcggacgaaaacagaccggaagatgagattaaacaaatcacaaaaattcatcaggcgatcgcgatgattcaattcaagcttgagagcccgattattaagagacggccgaactttaatatggaagaacggctgttactggaaaagattgattatgaccgcaatgaaattacgctgaacggaaaaacgtatcaactggaaaacacctgctttgcgacggtgaatcccaaacagcctgacgagctgctagaagaagaagcagaagtcatggacaagctgctgttttctgtccagcactccgaaaagctgggccgccatatgaattttatgatgaaaaaaggcagcctgtatctgaaatataacggcaacctgctgattcacggctgtattcccgtcgatgaaaacggcagcatggaaacgatgatgatagaggataaagcttatgcaggccgtgagctgctcgatgtatttgaacggttcttacgggaagcctttgcccatccggaagaaaccgatgatctggcgacagatatgacttggtacttatggacaggcgaatactcctccctcttcggaaaacgggccatgacaacctttgagcggtatttcattaaagagaaggaaacgcataaagaaaagaaaaacccatattactatttgcgtgaagacgaggcagcctgccgaaacatcctgaaggaattcggcctcaatccggatcacggccatatcatcaacggccatacaccggtaaaagaaatcgaaggcgaagatccgatcaaggcaaacggaaaaatgatcgtcatcgacggcggcttctccaaagcctaccaatccacaacaggcatcgccggctacacgctcttatacaattcctacggcatgcagctcgtcgcccataaacactttaactccaaggccgaagtgctgagcaccggaaccgacgtcttaacggtgaaacgattagtcgacaaagagcttgagcggaagaaagtgaaagaaacaaacgtcggtgaagaactgctgaaagaagtggcgattttggagaaactgcgggagtatcgttatatgaagtgaagaatatggagttcagagataattctctgggctctttttttacggttgcgaactaaaaagtccctttccctgtatgtaaaacggatttaaccgcttcttcaatctccctgtaacccgtacatctgcaaatattggactccagccaattttttatcgtgtcatcacttgcattcggctcagtattcactaaagcatgacaattcatgagaaaacccggtgtgcaataaccgcattgaaacgcgaatttttcaataaaagccttttgaatcggcgtattgatcagtccttcaattgtcgtaatgtcctttccttccccttctgccgcaagcattaagcaagatttcatcggtaccccgtccgttaataccgtacaggcgccgcaatccccatttaagcagcccggttttgcaccagttaatccgagacgaagacgaagagcaaataacaaagtatcagccggtctgaccgtcatctgtctttcctcgccatttactttcaacgtaataagatcagacatttggacctccttctaattcccgtaaggcatctaaaattgtatgttgcaagacaaatattcggtattcacttgagccttccgcatcatcaagaacgggtttgggtacatactgtaaagacctgcgcgctctatcttctaatgaatagcttttatcgttaagcacagcctccatttcagcagaacgaaacggaaatggacatacgccgctgaaagccattctgatctcatcatcttttttcagcgcacagactgtcaccaatggatatccgacattccactgctgtcttcttttgatactgacaaacggcaggtcaacgtacgctcgatcgacaacgatatgaaatagaaaatctccttttcgcaattgtatttccttgttaaatactttatttataggatggtaatgaatccccgctctccctgcaatccctagcaaactatcagaaatcaacaacggcagcacggcctcacggtagtagatgcccccgcaaatgtttccgcccaggctgatcttatttcgagtcgtccgatcggctatttcacttaccgttttacttaatagcggaaatggattttcttcctccagtttcgttaatgacacgcccgctccgatcaccagataacgttcataaaaacggatggcgtgaaattccggaagcgcgttcatatctatcaccgcatccgtatagacgatattcagccttcctaacgtgataatttccgtgccgccggaataatacatcggtgttttcttttcagccgcaagcgagtgaaatagattgattgtttcttgaatggtcttcggtttaaaataatcaaaatcaaacggtatcatctttccacccctcttgcgtcctccataattgttcgggaatgagaggaagttgattcaattggacacctaaagcggcggaaaggcaatttcccaatgcggccggcatccccagcagtccgtgttccccgccgccgcgcgctccataaggcgcaatctcatgcggggtttcaacaaattcaatgatatattcaggctgctctccatagtgaagggggcggtatgttctaagctgaggatttaatactctgccatatgaatcaaagacaaaggtttctcttcctccgaatgcgattcccatactcatcccccccatcacttgaccccttgcagctttttcattcagtacagttcctatatccacaacagaataggcttttgtaatccgatacgtataatcccgtttatccaactcaacttcaattccctgagcaccgacagcccactcgggtcccggctttcctcttcccgtttcccggtctaaattcgtcatccgggttaatgtataattgccgctcgcaatgatttggccgccaatggtatttccatttggaaacgtgtatccgtaagcaatgtcttttatgtcaacatgtacagcaggatgatctataaaataaacttttccgtctgccacttccaattcctcgacaggaacccgcaacacgcatgatgccacttccttaagctttcgaatggcttcttccgctgcattcagtacggctcttccggccattaacgtccctctgctccccacggttttccaatgctcgggcgttgtttgggtatctacaagcattttcacgtgaattttgcttatatccattttcattcgttctgctaagatttgggctagcactgtttttgtccctgttccaatttccactacccctgacatcaaattaatgcttccatcaggattaaaggttaaaatcaccccggacgttgcatttgtatcaaatgttgaggttttccaaatacagctgatccccttcgcccgtatcttccggccgtcgatttcaattcgctgtccctcgtcccaattcattaattccttcaatctttcaatacatttcggtacatttccgaccgtgcttgaattgagaagaacttgagtcggtgtggtgtcaccggggcgaatggcatttttatagcggagttctaacgggtccatgttcagcttttccgccaatacatccatcgtccgctcaaaagcaaataacacttcagcatggctgtagcccctgaatgcacttggatatggatgattcgtatacatacaatatgaatcacacgatatatggtcgatagcgtacggacccgtacaatcaaccaccgcagcccggctgatgtccactcctttatcagagtatgctccgccatcaaataaaagctgaatgtccgccgcctttaaaattccatcctttgtggcccctaatttgacaatggcatccaatcctacatgaacgggagatgtgatcatatcctcttctctcgtattaaacaatttgacgggccggcctccgactgcttttgatgccaaataggcaatcacctctaactgaacggctgcttttcccccgtacgccccgcctactaaaggcgttttgacgataacctttccgggttcaattccaaaataccactgcattaattttttaatggcaaaaggagcttgagaggatgtggtaatgataatctcctcatccgcccgaatttcagcgatcgagcatcttgtctccatcgcagcgtgatcagaagggttaaaggaaatctggaattctgctgtcacatgactttccctaaatccgtcttcaatatttccttttctaaccttatccacgtttgcgatatttgtcttcggaaccgggaatacaccttttgtcttctcatagcggtccgcatgttcatggacgagcggcgcatccttttgaaaggcctcacggggggaattgacgacgggaagaggtttataggatactttgatggcatccgcggcctttttagctgtaattggattttccgcaacaacaacagcaaccggctcaccatggtatctgacccttttgtaagcaatcggcgatctgtctttaatttcctcacctgcaagcggaaaaggttcatcccccaatatcgctctcacgccgggaatcttccaagcttctgaaaagtccatcgacacaatatcggcatgagcatatggactggtcagcatttttgcgtgcaacgtccctgtttcttgaaaatcatccgtatatttcgctttacccgtcactttttcaagggcctctttccgaatgacactcttcccgatatactccaactcattcactccccgaatttattcagcagcagcctataatcttcaactgtatcgacgtcataaaaaagcaaagggtcttgaaagctgatcatttttcccgccttgatcatactttcacggatgacatgcctggcgccctgatctccctttaattgatacaagactggaaaacattgattggagaataaaatggggggcataggaagatgctgattttcagcggcgataaatgaataacggcgctctttttgataggaatcaattaacgtattgatgatatctgcggtgacaaacggctgatctgcaaggagaatgataacggcgtcagcctcgtacgctgccgctttttttacaccgcattgtatagaatggccttggcccttacccgcctgctcacattctgcctggctccacttatttgacatgggatctaaaaagaaaaaatccgaaagccaatgcagtgaatctccctttcccgtaataacgaaaatatgatctaattcagataacaaggcatgtttaagagccatacttccaagggaaacgccattgagaaataaacttcgcttatccgtccccatgcgtctgcttgtaccggctgccaggtaaatggctgctgttttcataagcgggacctttgttttcgcatttctttaatcagctcgccgacgatacttacagcaatctcttcagggccttgtgccccgatgggaaggccgataggggaatgaatatcctctggaatctcagctccgcctaatagccgctcggtgcgccttctggggcctaatacacctttataaaacacattctcgttttttaatgtatgtaaaatgatctgatctttttgaaagctgtgcgtcataataacaacaaaatccctttgggtcatgctcaggccttctatgacttcttccggtgctcctattatcaaatggccggcttcaggaaaatggccgtgatgacataaagcgggacgccagtctatcaccgtcacatgcaagcccgcacgagccgccaacgaaacgagcggccttgcatcttctcctgctccgaagatgtatagacaaggttttggcaccatctgatggataaaaaataaatcagatgtatgttcatcccttttgattcccttttctgtctgtctcagtttttgaatacagccttgttccatatccccgcttccaaacactctgccgtcttcagctatatacagatcttccttcggctctaacgtttcagtgaatcgtttcactcgggtcacagactttttttcatctaagcatgtcttgactgtcatcagatttcgttccaattccccttttacaggctcaagcaacaccgtcaaagcaccattacagccaacaccctgcccccaggataaatcgtcctccgcactcatatcaaagcgaacaatcaacggctctcccgcagcccagatctgctctgacctttcagcaagatcttcttccagacaaccggcggataacattccgactcttgttttgtcccctaaaattaacatggaggccccttccttcttataagcagacccctctgttttaatgatggtagctagtaccttagctttcgcagaagctgcgatgacatccaaaatccggtgtatatcatccatttgatttcccccgcttttacctgatcatctgtatatccatattctttttttccagagaacattacaaacgcttcagcaatttcttcgtttctaaaaaaaaagagtctttatagaccttatgaccgggcggcgggtgcgactgcatgccggaacggagagattccaataacatgttctgttccttctgtttccaattgtctgtttcaccctgccgtattcctttaaaacctgcaaaaaattcacttaacacttgtaaatcattgcccagctcccttttgtcacttgaagataaagctccttccctttcccattcttttaacgttttcacgacattggatatatactcatatccagcattcatcttttgcatctctgtttgatatcttgcaagaatgattttatgtttttttctgatggggttgaatttcaagctctcagaggctgtttgcagcatctcttttgccgtatgcagctcctgcagaaggttattcactctaccttccatgagcgtcccttttccttgtccccactctgattgcacccattgggaaaggtctgaaagtgtgtcagaaagctgatgagccaatgtttgaaaagagtccgctgccctttttgtatagtccggcggaaaaagaaacatatgaaccagaatcgcgatgacgacgccgatcaccgtatcgatgatccgatccattgcataatctttagagtgtcgttcaaacgtaaataccaataaaatggtgagggctacttgatgcagaaccgtttcatctattcgtaaccacttcgctatgtaagtcccgcctaacaggaacagccccagcatccagccattcattggcaagtgactgacaagaaaggacgttagcatgatcccaatcgcagttcccgcaatacgatgaaaagaaaagcaaatcgactgatctatcgttggctgcaaacataagataacagatagaggcgctaaataggggtgatcagagcccgccagttttgccgcttcccaagaaacagcagatgcaaccgccatcttccaaaccaaagatgttttgttttgaattttttcacttttcatcatacgccccctcctttcagaaaccttctccactaggtttccgtgacgcaaagggatttatactgttgtgtgaaaaatgcggaagaagctgttgttcgcaataaaggtgcttctctgagctcttctttacggtttctatcctccttgataacttcgcatcagatatgaaccctgctctcctatgactttcgaagggaaacatacaaaccttgttggttaatgtgatgaaattgggtgaattttttatcattttatatggtaagggtttaacaagcagaatgcctttgttagtatggcaaccaaaggaggaggatcaatgatgcaaagcagaatgaagctaaccgcagtgaaactggcagccttggtattcctagcaggtgcctttgccctcccggttttacctcatgctgcggctaccgcagaatcccaagctacatacaaagttgaaaacctcaacgacagtgagctgaagatgacgttcaatcatgcagatgttcatattgacgctaaaggcaatgcaaccctaaaagacaacataacgggcgaggagcaggctcttccgaaaagctctactgacaaaaatggtgaccccgttacactgaaatatgaaaaaatcaaaaatggcgttttagtcaaagtcgtaaacaaagacgctggaaaaacaagcgggtcaatcagcacccaatcagtcggaaaatgtattttaggtactggcggcggtgcggtaactggaggcggcacactgggtctcgcaggagctgctgtaggaacagtcacaatacccggcatcggaacagtaggagcgggtgccgtcggagcaattaccggcgctgttggcggtgcaatgacaggagctgccgcatcttgcttttagtcctgaagaaaaaggggcccgcgcccctttcttttactaactatggaaggtggtcgacatgtacaaaatcatcattccttcaatactagccatcttcattctctggatactcttacagatttcgctggagataaacatcgttaagaatccattgaattactttattgtattcatcgtcttctttctctttataaagatggtgaaagagaagcaacagtaggttgcttctcttagctgtggaaaccggatttgtagtggatctggttttttgtgttttattcatttgtgaaagtcaaatgtgacgtatcctccgttaaattagcctgccacaaaacggagattttaaagattctcataacaaaaaagagataattaaacatagtgtccaataatgcgttttttcccttctttcaataaatatttctttttatgataaggctgttcatgtctattataatggtattttacttatttgagttcatctgcggttgccgctacttcattttcattctccaaaagacggggttgtattactttatccaggtaggatatcattctaccagtactaaaatgagttctcgattcagatgcataaaatagatatatatcaccttttaactcattgtattcatttataattacattattgatcatattcttaaacctctcaaaagctttcctaccttcttcagagaaccaaaatataacaagcttgtttcttttttgggtcttagaattgtgttcttttaataagtgtattaatctataacccatatccatatcattacttgttgtaaagttcctatactttatttcaaaaataatgtcacccaatttattattctctgcaaatatatcaaattgattaattgaattatttatatctctgtttttccaattattatacacattgtaaccaaatactgttagatgtctattaataacataaaaacaataccgttcaaatagttcagatattgaaatcctaatataattggtattccggattatctgatcaacctcttttatacttaacatttctccgtgtctaattttattacttaatctgtataaacctttgtttctatcacttaaccattccccctctataatacccatgtccactagtttcttcacaagtttcatgaggctctgtttactgtatttgtttttatctccttctatatctactagtatatccctgcagtatttttcaatctctatcataccttctaaaaactttatttttccttgagattggtcattactaataccatctatttttatattcgcttgcgctgtccatctgtaatagatttcttcatcatcattatttgattttttccccagcaagtttctatctaacaaactgttcaataacttattacacatttcatttaattgaaacttagtccaaaatggatattgttctgagtaatctccttcaaaatcataaacttcactattggtgaaatatgtgttaccttttaatttcattttcttaatccatataaataattgataagttaaaaaatctttaactccgctatcaaaatcagagctgtctatatttgtttcaactatctttgttattatctctagtattattgaatcagttttataagaatctaaattagattcatctattaataaataagattcattactatcccactcaatgtcttgtaaaattaaattgttaaatcttctcaatgttctataagaattcagaattaatgaatccttataactacttattaattcagtatttatattagatgaatcaattaaataagaattaaacaatttctctaaacctatattagtagtcaatggaatatgtatactcttcgcaaaaatacttgtcataattgaatcatctagcacgctggaatttataaatttataatataacttttgccctgatattacaataaaactagctaaatctgataaaagcagtggttttaaatcagatattatacttgtcatatcattttcgttttcaattttatctaactcatcaagaacaattattgtttttatgccttctttcttcaattcctctagaatatttcttaaatgatactcagctatttcatcatcatataatgactttctatttaattcttctacacaggaatttctcttttgaattacaagttttaattttgatccatctataataaaccagcatatactcaacactaataagccgacatccgaattcttaaaaaggttgggaaagatatcgaagctaatatttaggctcataagaactactaccactaatggcattaaagacttaactatatcctttaaattaaaactcccttccaaattactattaaactcttttaaattcttgaaatttgaactgttgaaaatctcataaaatgtatgatcatagagcaattcaatattatctattaattgtttattttttatttgtttatatattttacttgaagataaagtgagatatatttctcttattagctttctcagaatcaatgaataatcttcatatttagaaagatttaagtgcacaaatatataacttttatcttgtatctcttcttccatttttttaatcagtgtagtttttcctgtgcctctatatcccgatatcaaaaaacaagaattatttccaaacaacaattgttgcgttaactgatctttaatttcatctatagctacatcataattgacattattctttatattcgatgaagaacttattttttttgaatctattctcaccctcataatataatctcacccttcaaaaagaataactacttatgtataaaataatatattatagtgtttttttactctcaaaaaaacgaattgaaatatacttcgtagatgctaatatctaaaaaggaataagcattaatgcttattcctttaggttactcttttagcatattatcaattatttcatccaattctttcaacccatgcttaattatttccaaatcatttttctctgtagttaaatctatcggttgctgagtatgtaccgaggtgtgcgctgtttctcctcttctagagccaaaagaatccatagtacttaaccatgctgtatctaattcaaatatatctattcctagtggaactagcaaattgatgaggtttttttgtttaagtccgtgattcattttaatcttttcttctttgaaatctgcacatatttttcctatcttttcttctaacttcatatattttctattattatttctttcactcacctcctcatatccgttgatttcaggattatcaagaaatttgtaatgagcaaacagagaaagaaggcttgtacttattttcttatgttgaaaccagttacttcgtgaaaagtttaacaattctaacgctctgtcctctaagtagctttccacttctgcgtgacatagtactctataacccctacacatatctagttccttagggtttaaatcaatgacagacttttcatacaactgagatacataatgattttctaagtcatttaatctgctttctagattattatatctattggaataggtcttaacatcttccaccattattcctccatcattatactcaaacggttatcggattttaccaattttagaactggaaagtctgtaaaggttgatattatatcagcaatcttattaaacctaaatctaactttagataaccctttagtagaagatgaaatggattcattgaattcactatcaattgtactgatgttttcaaaatcttttttgaatccttccttattcttttttatacaattatatatttccttatttgaaagataaaaagtaaatacctcaaataaaggtctattaaatctattattatacttatttccgtcaaatctgctaaaagcacttttaccaaaaatatcgatacatagattgattgcgttttctaaatccctaaagttttctttgatttcaccctcctttttttcccaattttcatttaataacagacaggtgtcatctaaaaacaattttaagttaccttcatttttttctaagttatgtttaaatgcataaaaccttaatgcaagttctacatccctcatacgggagtcaggttcgttattattaagaagttcccagaatgtttgactatttgcagttgcatcatctaaaaagtctaaaaatgggcccggatgaagtgcttgtcttaactcctgaggtgaaagtttcttacttcctgtatttaaacgaaggaagacggtaaataaaaattcctcatttggccaattttttatgacaaccgttcgaattgtttgattttcaaattgatttttgtaatcaacatagctatagtcatcttcaatttgttcaatgattttcccattaagttctgttaaaaattggagacttctcaactttaacttgttaaaaccactttctttttttgcgcaaaattgtctaattgcaagaagcctttgctttccatcaataacgatatacttacccttattgtcttttttctcagcaagtataattggtgggacgggaattcccagcattaatgattccactagccttgatttattcatatcattccatgcatccctacgctggaatttaggatttaaatcaatattacctttgctaagttgagagttaatagtttctaccgtccaatcagttccccaaattactgcttcagaaaaagtatcaggaactgtccttagatcttcttcactttcttcctcatatttttcaaattcttcataattcacatcaaacatttccaacaccacccttataaattttttagttatgtcttagaatcttatttattttcctaaaatccgtcaataaaacccccactcacttatgataaggctccccacgattaatccgaaacgcccgataaatctgctccactaaaatcagacgaatgagctgatgaggaaacgtcatcttcgagaatgacagtttgtcgtctgcccgtttcatcacggcgtcactcaatccgagtgagccgccgatgacgaaggcgattttgctttttccatatgtcgccagcttatctattgtatcggccagttcttcggatgttttcatttttccttcgatggcgagggcgatgacgtgggtgtccgggctgattttggccaggatgcgttcgccttctttgtctttgacgattttcatgtcttggtcgctcaggttttccggagctttttcgtccggtagttcgatgatgtcgatttttgcgtaggctgagagtcgttttttgtattcttcaatgccttgcttgaggtatttttcttttagttttccgatggtcacaatattgatattcacaggtcatccccactttagaaacaagttattcatatatattatccacaattgtggatatcttttctgtattttgtgtaggatcattcgttccctactagatatgttgcagtgtccccacataattcacaggctgtggataaactgttagtatgttcgatttttctgatttcgggcggaagctcatgatcgtctatgtacatgtccagcacggtttcgatatgttcttcacaagaataataagcggttttcattgttacatcctccggttttcttttgcgcgcggcaattgttctcttttcaatataacctatttatacacatgttagtagtgcttcgggctgagttttatccacaattcggcaaatgacgcgcaaaaagagccggcgtttgcagcatccggctctttacgtgttttctcttttttctaagcgaaggacgaacagaattcctaatagacacgccagcagcgtacagcatacatcaatccagtccggctttccgccgtttagaaaagagttggttatcacggaaaccaggagaatggttacggtcaccgcggcaagctttttcttcatcggctccctccttcacctgactgtcttctgcttttacggttcaaattcctctatttctttttcttgctatatagccttatcatgagggtcacaacgatatatacaatcataatcaatgccccgttactcacatcagggtatccaatcaatatattcattatgacaaaaacaatggttatacaaatgacggacaacaataagaagatactgaatgatttcaaatgaacaccttctttcccgcagtaacgtttcattataaaaagcttaccaaaagcggcaagctcttccgaaatgttcatactctttaaaacccatccatcacctgcacatcatacagcttgagatggcttttcggcgtgacgatgttttttaagtttgggatggtcaggtcgttcagttttttgcccgttttcaggtcgaaggattcgattttggcgggctttttgtagctgtacgtgaacagatacagctttccgttttgatgcgtcagttctttaaagtcggccttcattcgtgatgcggggagggtgaaggcctttttgctttttccggtctcagggttgatgcggtagacggttccgaagccgtcaacgaaatagaagctgcgatgctccatgaaaaagctttttttgaagctgaacggcatggagtcatagatcgtctgttcgtcatttttataagcggcgatgtcatacgttttgatggcgccgctgtttttcatgactttcaccatttgatagatgtgatcggctttttctcctctggtaacaaagcagacagcgctgtcgtccacggcgagctgggattcgacagacgtgccttctttatacgtccacgtcgcgattgatgttgtatggagcttttctttatcggcctgaatgtcttggacgtgatagcctttttcgtcatctgtcggcgtgagcgcgaaaagatgatctttaaaaaagcctgaggcgcggatatagtgcgggatgacgtcttgcttccacctgccgtccatctggcggtacagctctgagcgatagctgccgccgctcttgtcgtagcccgaattatacagcgtgtaaaagcctttcgcccgttcgatatatcccgcgctgtctcccgtatgctggtacgctcttttatacgtgtgaaggccgtcctgaacggtgtagattccttttttgtcctccagcagcacgctttcgtcatgcactttggccgatccgagctcaagccccttcatttgataagaagaaagccgccctttttcatcggcgaagagggcgtagctttttccgccgccgaacgtgtcttggtcagccgcagtggagaaatacagcaacgcctctttatctttcagaaaatcagggtcatttaatgtgtctctcgcaacctccgcagggtcttccgtgcggaaatagaagaagcataagaccgctgcggcggcgatgatcactaagggtatccagatgatttttttcacgttgttctccttagtgaatggtcaggatcgtggttgtgtaggacgagcttgtgatgtcgcgcgggtatacgcctaagccgccgttagagtcgatatcaatccccgcttttaaaaggaatgccgaccacagcagttttgagcagtttttggcgccttcatggcccgtatttctgttattgacgaagttgaaggagtactcatcacccactcttgatacggcccagtcagcggcggcttgtttttgagcatcggtaactttcacggtctggacgattgaattgtcttcgacttctctgccgttataagcaatctgacggacgccgtctcccggcacggattcgacaattttatcagcggatgaatacatgccgacatgcccgtgattgtaataagccgtgtatgagttcgtgtaataaatattgccttttgtgcttttcgggagtttttttgtacctgatgatccgcccatcgcagagagtccttctttggaagcgattacatttccttgcaccttgtctgccgtgatttcttgatgaaactgcttgagaattgcttctgttgaaacatgcttctgtttggcaagctctttggcggattggagaacgtcttcaggagtcgtgccctgctgaaggtctgcgatttcttttgcgtagcgtggtatttctgtttctttcgcttttacattcaaaccggagaacgacagaaccatggtgaatgacagggcaaacgggaggacggctttgaacagctttttacacattgacttcgcctcttttctcaaaggttaatttttccacgttttcattatatgacgaaattgtgataaaaaaatatacaatttacagatttttaaaaattttataacaatatgtaaatcatatacataaatcattttcaaatatcaggaaatctggttatcatacaagaaagggggaggacatatgaaggacagaacgatcggttcgatgcgggtttccgcaatgggattagggtgcatgggcatgtcggaatactatggcagccagagtgaggaagagtcgatctccacactgcatcatgccgttcatctcggcgtgaatttgtttgatacggctgatcaatatggattgggtgcaaatgaagaacttgtcggcagagcgctcgccccattcagaaaggagctgtgcctcgcgacgaaattcggttatgtccgaagcgaaaagggtgagtttatcgaaatcaacggacggcccgattatgtgaaaaaagcgtgtgatgccagtctgaaacgccttgggacggattatatcgacctttattatctgcaccgggttgatccgcgggtgccgattgaagaaactgtcggcgccatgaagaagctgattgacgaaggaaaagtgaggtatatcggattgtcagaggcttccgcagaaacgatcaggcgcgccgtccgcattcacccgattgccgcgcttcaatcggaatattctttatggagcagggaagcagaggagcatgtgctgcccgcctgccgtgagctcggcatctcatttgtgccttacagtccgctcggcagaggttttctttccggaaagatgacgtcgacagatcagctggatgccgatgattaccgaagaagaacgccgagattccagggagacaatttggcggtgaatatagggctcgtccaaaaatttaccgccattgcccgggaaatgaatatcaccgcgcctcagcttgcgctcgcatgggttctcgcaaacggcgatgacctcattccgattccgggtacaaaaaagaaacactacttggaagagaacctcgccgctctcgacattgtgcttccggaggatgtgaaggcgcggttggatgaaatgtttccgatcggcacggcggccggcgagcgttacccggaacaaatgatgacattgttagatgaataacaaaagaggcccatcgtgcgggcctcttttcatgacagctttttgctcataatgacatccgtctccaggaatcccgtcttctcatacagcttccgcgccgtttcgttatgagcgaacacatggagagaaatcttgcggacacccagatctttggctttgtcctccagccttgcgagcgcctcttttgcatagcctttgccgcggaaaggcggatgaaggccgaaatcataaataaatgcgtcctgctgcgggtggtccggatcggcgtgcagccaaagccagccggcattttcctttccgtccaatgtcagcgtccataaatagtgatcggctgtctccaagccgtctggaagcaggtcttcaaacgccagctccgctaattccggcgcttcttcaggcagccacgttcccgcttttaccttttcttcagcgtaatgcttggttgaatgagcgagataggactgaaattcttgtcctgtcatcggctgcagcgtgatagccattgaatcactccttacacgaaagcggtatcatgcagtattatccgaaggctccgttttccgccggttttatgatttgttcggcttgtgccgttgaaccagtttgtgcaaataatccaatcgaaatgagacttgccaaggctgctgagagtacaatgaatttacatgttttcattacgaatcccctccgttaatctcaaaatttggtcattggcatcaattgattcctgaaaatacttcgccgccggtttgtatttctcctgttttttaaaatgcgccgcggcctgatacgacaaatcggaaacgtcactccacagctctttccttcttaactcggcgaaagctgattcaagcgcttcttcattgcggtcaataaagacatgctgtaagatgcgcagcttttgggtgtatacgggctcgtttttttcttcagcggcattcagcgctttatgcagccaaaaccggccctcatccgtcttttcctgcttcaataacactctggccagcatgtagagactccgcaccgaatacgctgatcgcaaatgctccttttgatcaagagccgtttcaaactcgacccgcgcctcttccagtttttcctgtctttcatagcaaatgcctgcgttaaagtgggcgagcgcttcaatatgcggatcgcccgctttggcggcttgatgaaccgccgtctgcaggagctcttcggctttctgatagtggaacaagtccattctgttacagccgatcaccattaaacactgtgcttctctgaccgcgtacatttcattggctttgtagatctccaacgctttttccgcgtggttcatcgcaaagtagttttggcggatttcatagtaggcaatcgccacttgataattaaactcggctctttcaatctcattcggtatgtgccggagcctgctttcagcaatccggtaaaaattaatggcgttcataaaccgtttacggtaaaactcgtgcattccggaaaagaaataataatagtattgaatcatctggtctgttttttctttatcggcgttcagctggatcgtttttaaaatgccgtctgttttctcatactcttccattaaaagcttatagcgggaatcaattaaattaaaataaaggagcaccgtttgattttgtgtcatattttgcagatccgtaagcagttgttctcttaacgcctcagccgattcagtgttgtgctttttgatttcctcataccagtcactgatttttttcgcaactgtttcgtgggccatcacttcagccatctgtcaggacacctccctttcccattttgtgtaataaatatatcatatttacaggtccaaaaagagggtgacagcccgctagtttcctcgtggcaacaaaaaaaacctccgcaggtgcggaggcgcatattttataatagtttttttcctaacaaagattccaccagctcgaccgctgttttgccggttttgtttttgtgatcgaggatcgggttgacttcgacaaattcagctgaagtgatgatgtcggcatcatacagcatttccattgccaaatggctttcacggtagctgatgccgccgacgacaggcgtgcctacgccgggtgcgtcgctcggatcaaggccgtctagatcaaggctgaggtgaacgccgtcacagtctgacaggtagtcaatggtttcttcaatgacctttgtcatgccgaggcggtcaatctcatgcatcgtatagactttcatgcctgtttccttaatgtattcacgctcgccttcatcaagcgatctcgcgccgatgatgacgacgttctccggcttgattttcggggcatacccgcccagattcaccagcgtgtcgtgcccgacgccgaggctgacggccagcggcattccgtgaatattgcctgacggcgatgtttccagggtgtttaagtcgccgtgcgcgtcgtaccagatgacgccgagctgtttatagtgctttgccgttcctgtcagcgttccgatcgcgatgctgtgatcgccgcccaagacgagagggaaccgctcattcttaatgacgctgtccaccttttgggcgagctgctcgttccccgagagcacagagttcaaatttttcagctcttcatcatgtttgagtttttcacgattgacggggatgtcgcctaagtcttccaccgcataccccatgtcagataaccgttcaatgagatgcgcgtagcggatggcgctcgggcccatgtccactccgcgtcgtgcttgtcctaaatccatcggcattccaataactgagatattcttgttcatccgtttttccacctcaacatgttgtatgttgtcctgtgcgggtttctcaaagatgacttggacacgaaaagatttaaagctctatctgtttttctgactgcttatgcttttttacatacagatgatagacgataacgcacaccgccatgaacgggatgccgcaataaagggcgagccgctgttctgaatcaaatgcgagactgatcagaacgaccgtatttaacgtcagcccgataataggcagcaccgggtacagcggtgttttaaacttcaggtcttccactttgccgccttcgcggatgtatttccgtctgaacatcagctgtgacagggaaatcgtgatccagccgacctgcgcgcttagtccggctaatgataagagaaacatataaacggtttccggcgctgccactttagacagcagggacaggcaggcgacggccagcgtcacgatcagagcgttcatcggcacgccgcgtttagttgttttgccgagtgatttaaaggcttgtccttcgttcgccatggcatataggatacgcgtcgatgcaaacaggcctgagttggccactgagagcagcgcaattaagataacaaagttcataatatcggccgcatatggaataccgatttgttcaaacaccacgacaaacgggctttccaccactcccgcctgcttccacggaatcatgccggcaatgacgatgatggagagaacgaaaaagacaagcgttctccataccgtctgccggatagagcgcggaatcgttttctcgggattttcactttctcccgcggcaaccccgatcagctccgttccctggaacgcgaagtttacggtaatcatcgtaataagcatagccttaatgccgttcggaaacaatccatcctcataaaaatgagagaagaaaggagcctgctcgccgtgtttcatgtcgatcaggccgaacatggcggcgccgcccaaaataataaacagcagaatgactaaaattttaatgccggaaaaccaaaattccgactcagcgaacgcttttgtggtaatcgcgttcaaaagaaacatcagtccgacaaacacgaggcaccacacccatacgggaacatgcggaaaccagcggagcatcaattgtcccgcagataaaaactcaatggcgcatgtcaccgcccagccgagccagtacagccagccgaatgcgaaaccgaaagcggggctgatgaatttggttgcgtacgtctgaaacgaccctgatacgggaagggcaaccgcaagctcgcctaagcagagcattgtcaaaaacataataaaaccgccgaccagataagacagaaccgcgcccagcggtcccgcctggttaattgtaaatccggtactcaggaaaaacccggtgccgatcactccgcctaatgaaatcataaacaaatggcgcgatttcattgtgcgctgaagctgattctctttttgatttgtattcactattctgcaccccttcagcaacttgtattggaaccaagccggtgctttgaaaccgatttgctgtccaaagagcctctatttgtatatgaatgttatatgaaattcattttcgtacataaagatacattatactaaaatactgtctccgcgcaaatagagtgtgctgaattttttatttgtaaattccatacaagccgagggaaagcattgccgcatcaaggttttacgcgttttgaagcacgtttgtgatcttttggatcgcccagtccaagtcttccttggaaatcattaacggcggtgcaaaacggatcacggtatcatgtgtttctttgcataaaagcccttcgcctttcagcttttcacagtacggacgggccgcttctgtcagttcaacaccgataaacaggccgcgtccgcgcacgtcttttatgatcgggttatcaattttctcaagctcttctttaaaataccggccaagctgaagggaacgctctgccagcccttcttcctcaaggacttcaagagatgcgagcgataccgcgcaagcgagcgggtttccgccgaatgtcgagccgtgggaacccgggttaaacacgccgagaatgtcacggttcgccgcgatgcacgaaatcgggaagacgcccccgccgagcgctttgcctaagataaacatatccggtacgatattttcccagtcaaccgcgaatgttttccctgtgcggccgagtcccgtctgaatttcatcagcgatcagaagcacattttcttccttacaaatagcggccgcttcttgtaaaaatccttccggcggaatgacgatgcccgcttctccctgaatcggttcgaataagaaagcggctgtgttcggcgtgatcgcccggcgcagcgcttctgcgtctccgtatggaattaattttatacccggaagcataggtccgaaaccgcgtttatactcatcttctgaagaaagggataccgcaagcatcgttctgccgtggaagttgccgatacacgcaatgatttccgcctgattatccgctactcctttgacctcatatgcccagcgtctcgccgctttgacagcggattcaacggcttccgcccccgtattcatcggcagaatcatatcttttccggtcagcttggctgttttctcataaaacgggccgagctgatcattatggaacgcgcgtgacgtcagagtgattttatccgcctgatccttcagcgcctgaatgatcttcggatgtctgtgcccctggttcaccgcggaataagcactcagcatatccatatattgattgccttcagggtcttttacccaaacaccctgcgcttcggaaataacaatcggcagaggatgatagttgttcgcgccgtaatgtgaagtttggctgataatttcttgagattttgtgaaagctgacataatctgattcccccttgttttgtaatcattcaacattagatcttgctttccctttttataaagcaagttccgtgccaatccgaaaaaacgggatgtttcgccagcattctttcttttcctgcaaaatattccggcagtttgcgtgcaaacttcagccaagcgcaaaatttttttgcgtttcctgctgacaaaataggagcaatccaattagattgctcctattcaacaattatttatttaattgtctctgatatacaatgtaagaatataataaacataatatgatacagccgattgccgcaatgaaaatgactgacactctatataccggcggcaaaaaagctgcaagcatcatgagtatgcccgctaagacaaaaattttcgaactaaccctgtgtgtatccttccaaactctttcactgctcagcgtccaaggtgttcttatccctaaaaagaaattaggcttcacgatctgaatgaagtttccaaataccatgaaaatgactcccactataaagtttcctaaataagatatagggagatcatatcccaggccggtcaagatggtcatcagattaatgacaaacagaaccgcaaacattgtattaaatatagccatatatggccggataaatgttttgtagttatttttaggatcaatcttagggatgataaccattaaaatatatacaataatcatgatgccaataagcatcatcatcgcatcagctttcgtttggtaatcatttgcacttccgtttaatccccagtgtgtcgccaaattgtccggtaaagatgaataagtgcaaacccatgtgaaaacagttaaaacaatgattcctgccgaaaagagatattttttcatgattccccgcctttcttattatcatgttctgaatcagtcagagaaaagaaccagcctataagatcctgtaatacagtggtatttaatgaatacataataaattggcccttcctctcatcgtgaaccagatcagtatttttcaatatggtaagatgatgagaaatactgggttttgacatgtcgaagtgttccgcaatttcaccagctgtcatgtcttgtttctttaataagtccaaaattcttctccttgtaggatcggccagtgctttaaaagctttattcaaaaactttccccctctcatacgtacatgatttagatatttaagtatatatctaaatatcaatcatttccctaaaaaagtcaatgattttattacctcaatttccatttattttaaacatcgtccaagcgcaaaatttttttgcgtttcctgttcgatttattttaaaataatgaatgttaagacgattgagagggggaattgacctgcacacaaccagcgaattttacacactcgtgttacaaagcattctggaagagattgatgtcgggctgcatgtggtggacgaaaagggcagcaccgtcatttacaataagaaaatgatgcagattgaagatatggatgaacgggacgtcctgcataaaaacctgactgatgtatttatgttttccaatcagcaggacagcacgctcgttcaggcccttcaagaaggcaaaacgattaaaaatgtaaagcagagctatttcaataacaaaggccaggaaatcacgacgatcaaccacaccttcccgattgtgcaaaacggcgagatcaagggcgccgtggaaatcgccaaggacgtcaccaagctcgaacggctgatcagggagaacatgcacagaaaagaacagaacagctacacgtttgacagcattctcggcaacagcccggtcattcgggaagtcatcgaaaacgcgaaacgggcaacccgtacgtcatcgtccgtgcttttggccggcgagacgggaacaggcaaggagctgttcgcccaaagcattcacaacggcagccagcgctcaggcgccccgttcatctcacaaaactgcgccgccctgccggacagtctggtcgaaagtattttattcggcacgaaaaaaggcgcctttaccggagccatcgaccagcccggcttatttgagcaggcgcagggaggcaccctgctcctcgatgagatcaactctctcaatctcagcctgcaggcaaaactgctccgcgcccttcaggaaaagaaaatcaggcgcatcggatcagctcaggacaaaccgattgacgtccgtatcatcgccacgatgaatgaagacccgatcaccgccatttcagaagagcggctgcgcaaagatttatactaccgcttaagcgttgtcacgctgatcattcccccgctccgggagcgcaaggaagacattctgcctctggccgaagtgtttattcagaaaaacaaccacctgtttcaaatgcatgttgattcgatcagtgacgatgtgcagcaatttttcctggagtatgactggccgggcaacatccgcgagcttgaacatatgattgaaggcgccatgaactttatgacggatgaaacgacgattacggcggcccacctgccttaccaataccggatgaaaatcaaacccgctgacacggaaagcaaagcagccgcaagcacccagcccggcacagatttaaaagacaaaatggaaaacttcgaaaaatacatgatcgaaaaaaccctgagaaaacaaggcaataacatatccaaaacggcaaacgagctcggaatcagcaggcagagcctgcaataccgtctgaaaaaattcggtctggaccggatgaaatgaatccatacaaaaaaaggctgaggtgctcctcagcctttcgtttatatctgattggcaagccgctctccggtaaaccaaaagttctcactcactgccaatgtatgttccgtattctcgacttgatgccaccaatggcgcggcgcgtaaatgatttctcccgccttttgcctgaagcggatcggagacgccttttgcgccagcggtttttgctctatatctttttcatcaaagacattgatatttccttcgtacaaatacggagagtcgtccggatgatagaaaatccattccttctccccgaaaatgacgccgttccacgcgtgcgtgctgttaaaatcctgatgcagcggcgtgcctgtctgcttagaaccgagaaagaaccatttccagtcccgtcccgtttcttcatccgctctcaatgtgtcttttgtaaaatactcgggtgcggaatagacaaggtctaagtcattttggttcagctgcgtaaaattccagtcacagtaccatttgtcatcattctgatcaatgtactcgatatagttggaaagctttacttgtttaaacgttttgaccccttcgatatctgatttccggatggtgaccattctgtctccatagtgttcgtcaatgtattcaagcgtccacggcctgcattcccagtgatccattgcccccgtcaaaataaaaggtttcttatcagcatactcgcttacaaaaagatcgtacgataactcattgattgtcagtctgtcaatggtcatatccattccccttttattcggcaatctgccgttttttttgtttggcgtaactgtatggacctgaaaagatggtgacgttttgattctcaagccagaaaatcttgttgaacttctccagcaggtttctgtcgtgagaaacgcagatgatggtgccttgaaactgcatcaggctgttttcgagaatttcctgagattcaatatccaagtggttggtcggctcatccaggatcaggacattcagctttttttccattaagatggacagcttcagcctgattctctcaccgcccgacaggacggaaagttttttaaagaccgacgacccgtaaaatccgtacttggccagcatattccgggccatgccctcttcagtcagcagattttctttaaagaattgcagaatcgtctgactcgaatctccgacgtggctcttttgatcaatgtagcctattttaagattttcccccactttaatggtgccgtccgacagttctctttccccgatgatgcagcggatcagcgttgttttgccgacgccgtttctgccgacgatgccgattctgtctttatgctttatacgcagattcacattttgatataaaagggaagatccgttggccacctttccgttttcaatgaacacaatatcttttgaaccggcgcccgcttcctgaaatgcgttttttaatttttgctccgtccggaccggcttattgatcagctcgatccttttcagcgccttttccatattattcgcgcgtctgtgcagcccgacagacggcggattcgagcggttggcccaatctctcagctgggcgatggattccttcatcttctgtatttttctctgctgttcttcatatttctcaaactgggcgatgatgaattcttcccgctttttcaggtattcgctgaaaccgtaaggccaaatcttcacctcggtatcgtcaatctcgagcactttcatcgccgtctggtcggcaaacgttttatcgtgggtcgtaaacagaatggttttattcgattttttaataaacccttcaagccactcaatcgcatgaacatccaaatggttggtcggctcgtccagcagtataatgtcgtcgttgcggattaaaatttcggcaaggccggcttttgttttttcgccgccgctcagctttgaaaacggctgatcctttaattcgctgaggctgagcccgttgcatacctcgtcaatcatcgcatgcatctggtagccgttgttccgctcaaatgtttccgtgtattgactgtacttttccaataaagcagtcagctcgtcctcacccatcggttccgaaagcttcagctcaatggccttcatttccttctggatcgccgcgagagcttcaaacgatttttccagatattgatacaatgtcagatcctcatggggatcagcgatctgcttcagcaaaccgaccttcgcccctttgttgatcgcaatcgttccttcatccgcctcaagctccccggaaagcaccctgaacagcgtgcttttgccggaaccgttcggcccggccacaagcactttttcgccttcattgatgaagaaagaaacttgtttgaaaatggtatctcccgctaaatttaccgtaagattatgaatattcagcaactcacatcatccctttgtcattctggttcaaagctcgactttattctggatggcgacgctcgctttcagtttgtaaaagctgagcatcataaacagcgacaataagatggataataccccgattgcggtcagcagcaaagctgaatcaaaatagtccgttaagaatccgataaacggaaaggcaatgaacatgaagagcgaggtcatcaaactgataatggacagcagcgtggctctcgttctggacggaatctcattattcaccacctgactggatacgggttctatcacatcatagagcgcgttgatgacaacaaaagctgcaatcgtcacgtacagactgcccgaaggtataaacagataggccgccccgataatgcagaatgtcagcagaagcacgcgcctcggcgtgaatttttccgccggctttgaagaaaagatggagcacagcgcctgcaagatggacagccccgcaaaaataatggatatattgcgcacggacagcccttcctgacttaacagatcttgtccgtacatataaaaaaccgatgtaatcgcaaagaaaacggagagtgacagcaccaaatatttaaaggctttgttcagcctgaagaaatctttgacttcttttaagatgtccccgaccgtctgcgtttcgtgttcactgttttcaaatttgatttccgtcagctgtgtaatgaccgccatcgcaatcagctgagtcacaatcccggcgataaacacatacgaccatgatatttcctgcaagtagccgccgatgcccatggcgatcgcaagaccgagtatgacaagtccgttataatttccgatggatttgccgtaccacttttctttcccttgttctttcagtgaatcaaacaaaaaggcgtgatccgttcctgatataaacgtcagcccgataccgtatataatatgagcgatgaagagggcgatgaagttatgaaagctcaggaacattaccaaatagacaatgaccataaaatggccgagcaagagcgatttttttctcccgattctgtccgagatgacgccgctcggcacttccgccagaaacatcgccaaattcaggaccgattgcaggatgcccactagaaacaatgaataattcatgcttgttaaatataaaatccaaattccccgttcgaaaaagaagtttccgaaaaaaccggagaagtaaagcaaatttcgattccgcaaatgaatacccctttccagctatctgcatttaacatcatgaacagaaaggagcccgtcagtctttacactaaaaccctctatacatggatcttgcagatacagacttttcccaaaacaaattgggcaataatgagttgtattctcgaataacccaaaaagttccttctttttttcagatcctatggcatcaatgatcgtttttttcttccccggatcgctgatgtcgcggatgaaatatttgatatagctcagctcatgcatataacccggcagaaacaaatggagctcaatatcaaacccgcttttatccatatggtaataatcattgaaatgactgacgcgggagacggatacgtccgctccggccctccgaaacaattcagccagcctttcaatgatctctccgttgggataataatcggcataaacaattcggatcggctcttcttttgtcaaaaggggcggatctttctgcggtgtccgcccgctttcccatataccgatcagtgaatcagtcggtgtgatgatatgccccaaatccccggccagcttttgtttatcaaaataatgctgaatgaaagttctcagcatgtcatcctttaccttgaaggtaaataacataggcaaatgattttctttaaaatcagcatattgccgatacctcatgttggaatgatgaaactgggtgtggcaggtcacatcggtctgattcgcttcgtacagcccgatgcttttttccagatcatcattcaaaataaattggatgatctgaacggtgcggtcatccgcgggcgtcattttatattgcggattccgctcaaattccagtcccttctcaaacgtacgcttgaatcggtacgggccattttccggcacatcgcccccggcggtcgccggaatcagaaagctgctctgcaaaacggcttctatttcatcagacggctcgtccaaggtgacttcaaagcgtttttcgcccgttacgttcaccccgagctgatcggatgagacgaggccttttacatacggaacggcctgttttatgttcaggaaactgccgagatggggactttggttttcttttgtcagatgatagatgatcgtttgaaccacaccctcggcgtcacctaaatagtccgggtgaatgtccacctgacaggtgcggcgatctttgcggatgattcggcagttatagccgtcctgcaggctttcatacataatgctgcaaatcatcttgcttgtgtaatcctgcgtatctaatgggttcaagcgtatcgggcttgtgtcgatttctattttcagagggtcgcccggttttctcgccgtacgatgcatcgtcttcataaagcgctttccttttgagaaagcttcgtttctgtaatatgaagtccgtcaaagtccaggccgatgcgggtattcagggatttcgggcttccgcctgcaaggtatgtgataatgtcatgagacataaacgaggatataataccgtttgtcgctcctaacgaacctttgatcggttcatcggggtaacagttcagaagtccggccggcatgtttttttcataggtgacgccggattgataggattcaggcgtgagcagaggcccccattggccgctgaagctgccgacacccccggtcataaacgcgatattccgctccttacaatactgataaacccattcagaaatgttatggggtttgtcagcggcatttatgacgatatcaatttcgtacggatctaacacacgcaggtcctgcggctgtgtcatttcctgatggtaaagtgctgcgtccgcatggggattgatacccgcgatataatctctgcattctgagatctttaatttgcctacagaagattgagtatagacgaattgtctgttcaggttatgtactgatacggcatcgaaatcaatgagaataaaatgctgcatgcccgccgccaaaaggttttgaagaatgatcgttccgacgccccccagacccacgatcgctgccctgctgccgtctaatctgttttggatcagattggggttttggttgtatttctcaaaatggtacagctgcttttcagtgatgcagccttcacggccgttttgccatggctctattaaagcatccaatttcattaacgcatcgaaaaactggtttcccgcttcctctcccagaagatcagaaagctcttgtttttcacagccggtgatcagccgttcaaccgcctctttgatctcactcgtatgcgcaagcttaatcgcctttcgatattgaatgataatatgccccgtgtaggtcagcacctgcacgctgtctttaaacttccagcgcttacagtccgttgacatcatgacataccccctgaaagataataactccccaaaaaggggagtcacggctttactagcagcgatgcaccaagcttgctgtttctgtatcaagatcaagttcttcaatcttcatcagtacacaccccctttgccaataactagatattatcatcaatattggaaaaggacaagttattttttgaaaatttagaatttatatataaattgtgatatttcttccgctatcccggtttatcccggcagccggatgatgaacacggagccttttccctgctcacttttcacttcaattgttccgttatggctgtcgataatggtttttgtaatggcaagacccagccccgcgccgccggattgacgggatcgggaggtttccggcctgtaaaaccggtcaaacacatgaggcacatgctccggagcgattcccgttccgttatccgcaatcataagcatgattcctccgtctttctgcagggagacggtgatgacacccgtgtcttcatccgtatgctgcaccgcattgtaaaagagattgagaatggcctgcttcattttgtctttgtcaaaaacagcttctatcttttgatcaacaaagaactcgagtttccggtttctcgcgagcagcttcagctcagcctccatttccaaaatgacgtctcccaatgccccttttttcatttcaaagctcggctcccggtcaatcttcgcgagaaacaaaagatcctctatcagcttattcgccctgacggattccgcgtacatgctttgaagcgctttttctttctgctccggcttttccgccgctccgcgcattaaaatttcgataaagccgtgaatggaggtaagcggcgttctcagctcatgtgatgcgtctgatacaaactgccggatgcgctccttcgcttctttttccgcctgaaacgcggtttcaatccgttccagcatctgattgatggagatgcccaatgactcaatttcggcctgcttcatatcaatcggcagccgtttatcgagactgccggcatgaatgtcacccatcatatgcacaatgcgggacatcggcttgagtgtgagccggatcaccggcaaaaaaacaaacagtccgataaccaaagccgcaaaggaaagcaccgcgaaaatgctgatctggcggaaaagcgaatcattcagaggctgggtcagcgtgctcatctgtacaactcccgcctgccttccgtcaacggaaatcgcctgaaacacgacgatgatttcctcacccgccttattgtgagccacctgatagtgaagcgccattgtatctgtcagcgcatcccgatacacgtttttcgggaaagaaggagcggctcccgcgtgcgggtcttctgataaaactgacatcttgtatgattgattgataaaagcaaccgtcaccccgggataaatcacattcggatgagccggtgtttcggaacgggcaggagttttgattgacctccatacactttgatccattgaattgatatcactctgaatgctgatcgcctgattttcatacatcgtccgtctcataaacatgtactgtgtaccgccgatgaaacataacagcaaggtcaaaatcgccagtgacctgaacaggagctggaaccgcagggttctgtacagccgtttcatgccaggtccaccctgtacccggcgccccgaaccgtgcgaatcaccttgtgttctttgtccttcagcttttcgcgcaaagaacgaatgtatgtctcgacgatattgtcttccccgagaaccgttccgtgatgaagccccatcgttaaagaatcaatgagtgcagactcgccgtctgcactcagcagcttgatgcctttcaacttattcatgatgcagtctctccttagatgtatcagcctgtgtttatttttttcgcttccccttctattattcgcttttatctgaaacaaaacggaagctaagctgaattggtgaaagtaaacgctgaaaacggagccatctgcaaataagctgccggcagtttcatctgccgctattcagcagcaccagtctgtttcaatcacaaagttctgttgtgacccgcgttcagttctttttatggcttctgaaaaaaggcataaaaaaagcgcccctgaaaaaggacgtttaatatgtcatgtttcattttcttaaattctgcattctaagataattcttccttcacattcaccctcgatttcattcaatacgatgatcacatcagccgttttcatgtgtttcacctccctgcttcacaatagtataatattaacaaataaatcaataaaaaacagcccggatgtccgggctgcttttttatttctgtaatcgatccgcttctgtcagtttgacttccgctgtttttttctttcccgaacggtagaacgtgatgttcacacggtcgccgatctttttgcgatacaggcgctcacggagatccacaacgtcattgaccttatgtccgtcgaacccggtaatcacgtcgagctttttcaaacccgcttttccggccggtgaaaacgcgtcgacacccataatgaccgccccggttttaacgcctttcggaagtttcagcgtctggctccaatggtagctcgcaatatccgttaaggatttcatctcaataccgaggaaaggccgtcggacttctccgtatttttctaaatcctgaataacgggaatgacaagctttgacgggatggacaggccgattccttcaacggcggattcagcgatcttcattgagttgatgccgaccaccttacccgaaatatccatcaaagcgccgccgctgttgccgggattaatcgcagcgtcggtctgcagcacttccgcattccaatccggatgtccgtcgccgtttgagtcaacgggcaccgctctttccgtgcctgaaatgatcccctgtgtcactgatcccgcaaattcaagtccgagcggatttccgatcgcaatgaccggttctccgactttgacttgatcagaattgccgaactgggcggccgatttgattttatcagacttcaccttcagtaccgcgagatccatcagacggtcgctcccgatcagctcagcaggcacgcgcgaaccatccttcaggctgatctcaatctcagtcgcaccttcaatgacatggtgattggttacgatataagaagtgtttccgttctttttgtaaatgacgcccgacccgcttcccgcttcgccgccctctccccaaatatcagtcttttggatattgagaacgccgactaccgaatccgatacacggctgaccatattcgtgacagcgtcattgacatttacgttgactgttttcacctgttcgctgccgagacgccggctggtgcttttgctgctgtctccatggtctccgcctgtccagtacggcatcaggaaagccatgagcgcggccccgacgatgacgccgatcagacttgatagaaagtatcccctcttgctgcggcggggctgttcggaggcgtactgttcatcatcgcgattataatccaccctatctcaaatcctttcaagagtactcgatttgcttatagtgtgggtcagatcgcggattaataatcatgattcatttggaaaaattacacggcgcacagcggcgtcggaattttcggatcggtatcaaataactgaaacgtttccccggcgacaaatcctttcgcagccaatgtctgctgcacggacattctcgccagttccttcatattgttgtcttggctcagatgcgccaaatagatgcgcgatgtgccgtcgccgatgacatcagtcatggcgagcgccgcatcttcattcgagacgtggccgacatcgcttaaaatccgccgcttaatgctccaagggtatctgcccatttgcagcatgccgacgtcatggttgctttcaaacacaaacacattggccgaacggatgatgcctttcattctgtcgctcacatatccggtgtccgtcatcagcgcgagctttctgccttggtagtggaaaacataaaacatcggctcggccgcgtcatgagagacgccgaatgactcaacatcaagcccgccgaaagattttacgctttccatcgggaacaaaaacttttgtccggtatcaagcttgccgatctgattctccatcgctttccacgtcttttcattggcgtagacgggtagaccgtactttctcgcaatgacgccgagccctttaatatggtcgctgtgctcgtgagtgacaaagatgccgtcgacgtcgtctatcttgcggccgattctctccatcagcccgtccatcgctttaccgctcaggccggcatccaccagaaaagaatgctcctctgtctccagataaaacgcgtttccggtactcccgctcgcaagcacgctaaattgcaagcccattgtgtctcactccattatttattttgattgttatcaatgactgtgctttccaatgcattcacagtgtacgtttgctgtgtctttttcttcgtcccttttgacttatcttcaattgtaattctccataccggcgccagcacctgcgtacttgtcagcgggtattgggcaatatagccgaacttgacgcttttaacggcgcaattcgcttttaagtaattttgagaatacaataattcgaccgcatcaagctcaggaatcaggctctcggtctggattcgcttgaatgactccagcatggtctgctcgtaggatacgacctggtttttatcgttcagatgcagaatcacctgtccgatcgcatccgtggacgagtcaaaatcctgataaataaactgtccgtcatatgtctggtaaaaaatgatctgtttttgatccttgtcgactttccacagtttatatttttcaccgccggttactttagaactgacgagcgattccgcatcctcctgcggtttttgcttcgataaaccgaccggatcggtaaatttcattttcagcgttgtgaccttatgatcatccgccggcatttccattaacggcttttgatccttcaaagcatcaatatcttcagcggtaaataccttttggcccgccgtcagccggtagcccgtcgcggaatcagaagacaggttgccgaatgtgatatggtccatctccatgtctttttccacgtttgaatttttaatcacttcgtattcactgctcgagcgtttttcaaaaaactgatagccgagaaaaatatcgaggatgagaaaggcaatgatgaagatcgtttttgtcttattccactccattatcgtcctcctccttccccagcagatctttcgtaatcgggacgatcttcccgttgattttcatactccagacgggttccagttcaacgagatcattcgttgaagaagagaccatttgataggacaggaagatctggtcgattttgttcacgtcgtatttatcctgctgctccagcagagacacaacctcattgccgttcatcatttttacgtcttttgttttaatcggattcggcccgagaacatagttcggccgcttgtagctgagaacctcgtcattggcccattgcagggtcaaaacaggtccggatccgaaaggcttagacgtgctgttgatcacaggcatttggtctttaaacatgtagaaactcagctgctggttatcactcacattaaaaaattgataatgatccgtccagcttcccgtatcctctaaatatttatagcttttcttaatcagctcacccgtttggtaagaagcgctttgtgccaggttccgatgctggaattgaatctgccgctgtgtcgaattgatttccagacggctgattccgtcagtcagcacattccgattgtaattcgggtcctctctgaccgtgctcggatcattaaaaagcgtctgcttaaacaggttcgtcttaatggtttcagtgataaattctttttccttcatattaaaccgcgcattcggcatgagaaattctttgctttttccgaccgaatagaggtggtataacggcatactcgactttttgctgtacagctcattcatcagattgcggtaattcgccgattccacagtcacttccaaaatcagctgcttgctgtacgagaccatgtaaatcttcttattcgtcttattctcattaaacggaataacaatatggtcaaatgagctgtattccattgacggatttgaccatttaaacatcgattggaagaaatcaatcggaatggtgtcattgaattgcagatcgagctttgccgaattgccgtttctgccgtaaagccaatttttaaaaccgagcttgtcgtattgatcggaaatatccttcatcccttttacttcccattgcggcaaatccgcccacaggtcattaaagagcgtctcatcatccactttataatgagagccgtttgtatgaataaacatatcccggggttttaccgtttgcgacactttttggctcgttttatcaattttatgcttttcccggacagtcgatttggttgaggccgtgccttctgaaaaattgggctggaatgtccaaattccccatgttaaaacaagactaatgacgaccagcactgacagtatgactgtttttatattttcacgcctcatcccaatcatcctcttgctcttctttatatggaagagtaaatgtaatcttcgttcctttgccttctacactgtcggcccaaatgtctccgccgtgcgcctgaaccatctcttttgcaatcgcaaggccgagcccggtgccgccgagttttctcgtgcgcgctttatccactctgtagaaacggtcaaagactttttccacatcttttttcggaatgccgataccttcatcttttacgctgatataaagcagctcttctttctcgttcacatcgactgagaaagtgacatgcccgccttccggtgagtatttcagtgcgttagaaatgatattatcgagaacctgcgtcactttatcctgatcaatctccacgtacagatttctgtccggaagctcgcggataaattcaacatgctgttctttcgtcatttcaaaacgatcgataatcagtgacataaagcggatcatatgaatccactcccgattaaactgataatctttgctgtcgaatttagaaagctgaagcaggtcgttcaccaatctgatcatgcgctcagtctcattttgggtcaccattaagaaacgcggagcgatatctttgttttcccacgcgccctctgcaagcgcctctaaatagcttcgcatggtcgtcagcggtgtccgcagctcatgagacacgttggcaacgaactctctgcgttcccgatcgagtttttcctgttcggtgacatcataaagaaccgcgattaaaccgtcgatttttccgtgctctctctgaataacggaaaaattcacccgcagtacagtcgtttcatcgtcacgttcgatctccagcagcattgaatcctgctgttctactaaatcctcaaatgtaaagttctcttttatgcccaataaagacgtaatcggcatctctaaagccgtttcacgtgaaacattcagcagctcaagcgcagggctgtttaaaagaataatagccccgttgcgattcgtagcgatgacaccgtccgtcatatacgcgataacggaagaaagctttcttctctccccttccgtcatggcttgggcatcttcaagctctctcgtcagatggttgaatgtcgttgcgagctgaccgatttcatcatgcccgtatttccgcacctttctggagaaattcccttttgccagttccatcgcctgcttacgcatatccgacagcggatgggtgatcgtgcgggcgagaaatataccgagaagagccgtcagaacaagggctaagcctgttcctgaagcaagaatcgagttgacggttttcatctggttaaaggtatcttccatactggccacgacataaattgcgccgacaacttcctgattctctgtgacgacaggttttgctgaaatcagcactctgtttttgcttttaggatcataatatttttttgaataggcctgttttgttgagaaaatccgtttaaaaatcgggtcagtcgtctgtttccccgctatttcctcgccataaggcctcgaagaaccgacgacctcatagcttttatcaacaaatgtaatctcccgtatttcattgtttttcgtaaaatcattcaaaatccgtttgacgtcatctttaatgacggtgctgtcattatctcctttatattcctgctcaatataataggaaagattgtcaatccgctgatttaacgataattcataggacttgagaagagaattctccacctgtttcacaaagtacacgccgataatctgcatggcgatgataatgagaagcacatagatcagcgtgatcttaaactgaatcgaccgaaaaaaaccaaccttattcatcgccggttagtcctgttcaggatttctcaagtaataaccgacaccccgtcttgtgacgatccagttcggatggctcggattatcttcgattttctcacggagacggcgcactgttacatccaccgttctcacgtcaccgaaatagtcatagccccacacagtctgcagcagatgctcacgggtcatgacctgtccgatatgtttggctaagtaatgaagcaattcaaactcacgatgagtcagctcgatcgtttcttctctttttgatacgacataagcgtcagggaagatgacgagagaaccgatatgaatgtcattagaagctgattcttcctcagccggcgcaaccgtaagctggcggcgcaggttcgctttgacgcgggccagaagctcacgcgtgctgaaaggcttcgtgacatagtcatccgctccgatttcaagcccgatgaccttgtcaatctccgagtcttttgccgtcagcataataatcggcatatcatattttttccggacttcccggcacacttcaactccgtctttattcggaagcataatatctaaaagaattaaatcaggctgaagctcctccaccatttccacggcttcgtttccatcgtacgcacaatgcacgtcatagccttcttttcttaaattaaactctaatatatctgcaatcggtttttcatcatcgactacaaggattttcttatccatcatcttgattttcctcctgccagaatgacttcatttcatctattgatgtttcatgatgatcacaattcgtatcgtgaaaaacgttccccgtctattataacggtttcaggtcaaaagataaaaaaattaaagagaacagcgcaaaaacgtattgaactgccatccttttgtcatgttttttattttcttttaaaaaataatatttttttgaaacctcaagaaaaaaaacgccgtctagtgtttgacgtcttcttctgggccggctgaaaagccggctctcccttttttataacaaaagaaaaaacgcacctactattgcagatgcgtttgggtaagtggctcgggacggaatcgaaccgccgacacacggattttcagtccgttgctctaccaactgagctaccgagccagatgtttcttttctatactataaagtaaagtaaaatggcggtccggacgggactcgaacccgcgacctcctgcgtgacaggcaggcattctaaccaactgaactaccggaccttacagtaatttgtccggagaaccgtatcgtggcggtcctccgaggacaaataaggagttagcaataacgctaaagtaaatcaatgacccgtacgggattcgaacccgtgttaccgccgtgaaagggcggtgtcttaaccgcttgaccaacgggccataaaaagtggtgagccatgaaggactcgaaccttcgaccctctgattaaaagtcagatgctctaccaactgagctaatggctcttgatgtgtcggattatgtatcatagagcattgagacaaaagctttcttgcagtactctattgaagctgttccgtaacaacgagatttataatatcatagaacattcgaaagtggcaactacttttttgaaaaaaatctattatttttttcctacataaaaaaacaagcctccgtgaccggaggcttgtttgctgcaaattcttagttagcgcggtatacactgcggatgacgttcgtttgtgaacgatcgggaccgacagagaaaatagaaagcggaatacctgtcagctgagatacgcgttccagataatggcgcgcattttcaggaagatcgcttaatgtttttgcgcctgtgatatcttccgtccagccaggcatttcttcatataccggttcacactctgcgagagctttcagacttgccgggaattcttcaatcacttcacctttgtagcggtaagcgacacagattttcaatgtttcaatgccagtcagcacatcgattgagttcagagaaagatctgtgattccgctgacacggcgggcatggcggacaacaacgctgtcaaaccagccgacacggcgcggacggcctgttgttgtgccgtattcgcgtccgacttcacggatttgatctccgatttcatctttcagctcagtcgggaaaggaccgtcaccgacacgggttgtgtacgctttagatacaccgacgacgtgctggatttttgtcggacctacgcctgaaccgatcgtcacccctccggcgaccgggttggatgaagtgacaaacgggtatgtcccttggtcaatatcaagcataaccccttgagcgccttcaaataaaacgcggcggccttcatccagcgcgtcattcagaacgacggatgtatcgcatacatactttttaatctgctggccgtattcataatactcatccagaatatcttcaattttgaagccttccgtttcatacattttttccagcagacggtttttctcttcaaggttccgttcaagcttttctgcaaacacgtcacgatctagcaggtctgcgatccggatgccgatccgcgccgctttgtccatataagcaggtccgatgccttttttcgttgtgccgatcttgttggcccctttgcgttcttcctctacttcatccagtttcagatggtatggaagaatgacgtgggctctgttgctgattctcaagttatccgtgctcacattgcgttcatgaagatacgcaagctccgttacgagcgctttcggatcaacaaccattccgttcccgatgacacacgctttttctttataaaaaattcctgatgggattaaatgaagcttgtacgtgacgccatcaaacttgatggtatgtcctgcattgtttccgccttgataacgtgcgatcacttctgcattttctgataggaaatctgtaattttaccttttccttcatcgccccactgcgtacctactacgactactgaagacatatatccgtgcacctccgttaacctttcaaaacgatatctcattcaaacaaattaagtgtatcagtgccgaaacagaaagtcaatcgtaaatccgaacattaaaatcttattattctatatttgttcgccttaaacctgattaaaagcgttttctctttcatttgctatctattactcccgaaactttcatactttaacacgaaaaagaacccatatcccgggttcttcagacagtcatttatattccgcttgtattcatcaggacgatccgccagccgtcaggatcttcgatggtcacgcctttttcttcccagtacgggttttcgggttctttctcctcatatcccatctgctttaatttcgtgctgatgcgaatgacctcctgctgatcagggacgtaaaagacaagcaggctgtcgccgtgcggaacgggcgccggatgagacgagccggtttcttcggtgaattctaaatgatattgcgtatgcggcaggccgaacatgacgccgctgtagccctcatgtccggaaaaactgccgaccctcttcaatccgaggccttcttcataaaacctgatgatttccttaagctgtccggtcggccgggcaatccggatttgcgccgcttgaaattgcggaaattcaattgtcatcatcatccctcccttaatgccattatataaaagcgctttctttttatcgactgccgaacagacggcattctctcattctttcggatgaaaaaaagcctcaagacattgcttgaggctttacgcacctgccggaacaccgccgtcatcaaagcgcctttccagatttacgaacttattgtattctttcacaaaagccagtgagacggtgcccaccgggccgttacgctgtttggcgataatgatttcgatgatgtttttgttttcggattctttatcatagtaatcatcacgatacaggaaggcgacgatgtcggcatcctgctcaatacttcccgactcacggatatctgacatcatcggacgtttatcctgccgctgctcaacaccccgggagagctgagacagggcgatgaccgggacttcgagctcccgcgccagcgcttttagcgcccgtgaaatttccgatacctcttgctgacggttgtcgctcgaacggccgcttccctgaatgagctgcaggtagtcaattaaaatcatgcccaatccgttctcctgcttcagccggcggcattttgaacggatttcgctgacgcggatgccgggggtgtcatctataaagataccgctgtttgacaggcttcccatcgccatcgtcagcttgccccaatcttcttccgtcagattacccgttctgagattttgggcattaatattcccttcggcgcagagcatacgcatgacaagctgctcggcacccatctcaagactgaatatcgcgacgctctcatccgttttggtagccacgttttgcgcaatatttaaggcaaacgccgttttccccacagacggacgggctgcgacaatgatcaaatcattccgctgaaaacccgccgtcatccggtcaagctcgataaagccggtcggaatcccggtaatatcgcctttccggttgtgaagctgctcaatgttgtcgtatgtttgaacaagcacgtctttaatattttggaaggcgcccgaattttttcgctgcgcgacctccataatcgttttttccgcatcgcttaataaatcttcaacttcatcctcgcgcgtatacccgtcttgagcgatcgaggtcgccgttctgattaaacggcggagaatggatttttcctcaacgattttcgcgtaatattctatattagccgctgtcggaacggaattcgcgatgtccgtcaggtaagagacgcctcccacctcttctaacaaatcggtattcgcaagctctgacgttaccgtgaccaaatcaaccggttcaccgcggtctccgagcacgagcatggcattgtaaattttttgatgtgacattctgtagaaatcatccggaatcaacacttcagaagccagtgtcaacgcagacggctgtaaaaaaacagcacctaacacggcctgctcagcttctatgttttgcggcggcagccgatcattcagaaggtctgtcatgctaagcaccgtcctttccttaaaaaatatccaaacttcattttaccatttctcatgaaaaagaatagaaaaatatcactttgcctgtatttgtcaggagagggttatgtgttttgccgttccgaatgccgggaaacaaataaataaatcgaaaccgggaggtaagaaggatgaaaacatatgcagtaacacccagtgttgatgcggacggatggtttgtgaaggtggaaaatgtggcgccgacggctctttgtacatcaaaggacgcggcgattgaaaaagcggagcagatggcgaaagagaacagcccggctaagcttgtcatttatgatcagcataaaaacattgaagaggaacgttccttttaagaaaagccttcgcccgtgcgagggcttttcttattcgatgaaacggatgtgcagcaccgtctgcgccatgagatcggccgttttttgatacagctcccattcttcaaaggcggcgaatactttcatcatgtcctgcaatgtctgtttcagtatgataaattcgtcaattgtccgcagttctgcggcttttttctgataatcagccagcttcagctgtaataacatcaatggcgattgcataaaaaacctcccccattctgttataaagccccgcttttcaaacctccattcctttgtcatatcctcttacgatagatttctgattttagtacaataaagaaacggaaggagtgatcacatgaaaccgctgcaaatttccgccgaaacggcgcaaaagctcgcagaatcactgaatatgccgcttgagagaatcatgcacatgcctcagcacattctgcttgccaaattagctgaaatccaaaaagagaacgatcacaaataaaggctgctctctcatatatatgtgcgggaggcggaagcgatggctttccgcctcttttttccatgaagaaaatttcggtaaaaccgtctcacagctgaaaaaacttgttgacgaaggaaaagtgaactatttcttataatcaggaaacaattcaggcaacacaaagcttgtctcatggattaaaaagaacggcacaaaaatctcacagcaccggaaaaacaggctcagcccgatgaagaatgacaggcggcccgggcggacaaagtcagcagactctgtatgagatgaaaaaacagctcggaaagaggctggatagttaaacaccggcctctttattttgctcttgaagcacctgccatacggcgccggtatcattcagaaaaatgattgataaatcctttctatttttgaaaccatcagttcctgacgcagatgccggccggcataggagcgcgcttcttttccaagccgttccctgagagactgatccgtaatcagctttacgagggcatcagcaagttcgcggctgttgccgggctgacagataagccctgtgtcctcatgccggatcatctcagggattcctccgcagtcagttgcgacaatggcttgacctgagaacatcgcttcgatgatcgctatggggaaattatcattcaatgtcggcaggacaaatatagatgattcagccaaaagcgccggcacatcatgtcgttttccgaggaaaaacacatttgtgaggcccagtttccatctcttctcttccagaaaccctctcatgtttccgtccccgatgatccatatatccactccggataaatggtgccggatgcgggcgagagcgtccagcagcacatcatgtccttttcgctcggtcagacgggaaacgcacgcaatcacgaccttttcagcacgttttggctcgggtgcaacccggatgtcaatgccggtatgaacagtcgtcagctgagcctccttcgctccgtactccagcaagggctcgtgaaaggagtcgctgattgtaatgattttatccgaagcccgaataccctgcctttctatttcactgaaatatgcctcttctattgaacccttttggattttatgaaacttcatccggcttttcgtgaaatgtccgtgcggcgtgaaaaaaagcggacgccgatacgtttgattaaggtatcccagcaaaaatgccgcaaataaatcctgcgcgtgaaacaggtcatattgttctaagtccttctccttcaaaaatctttgaaagacatgtaaatagctgagattcttcacaaacttttcgtttgcggccccgtatctgccaacaagaaacgctctgatctcgtcagcggcccgcgggatatcttcctgaaaaaaagttggcggcatttggagcggcgagatgacatccgcctggtgaccgatgcgctcaaaacccgtcttaattgacgtgatataactcgccagtcctccgacattcgggtaacggagaaaggttgcgtacagaatacgcaatggcttttttcgtttgggggagctttttccttccgcacagaacgaatacagcatctccggctcactttgatgttcgatcccgtaaaattgatccatgacgcgcaataaggttagaggcaccagaccgttcggcttgccgatctctcctttcaaatccgctccccctctcttaaacttataatcctaattcccgtccccattttgacactttgtcaacatgatacggcagcagttctcctccccgattgtcgaagattctccgcaattgggtatgaagccctttctcaagtgttctctgcaaataagccattttataaagcgtcataggaggggtctgaaaatgaatgccccgctttttcatttctttcgtatacacttttacgcaatacgtccgaatatcttctgcgtgccggctccagtcttttctgaagccgagcagaatttcgaccagcaccgtcatatcaaaccaaaccggcgcgtactttgcggattcccaatcgatgaattgaatatcccacggttcatgtccggacgcatcgtgggtgcagatattctgcatatgaagatcaccgtgtgtgatggctgagccgttttggaccaattcagggaaaaaacccggctcctcctgctccagcaagtttgtgatttgccgataatgaggcttcacgatatcctttgtgcgctcatctttaagagctctatccaataattccgctgtctttttgatctgctttttacgcccttttctcatggtttccgattcgtatagcggcagccacgaccgccatttaccgtcagaaacagccttgttttcaaaggtgcggctgtgcagttctgcgacagacggaataatatacttgaaatgcttcggatgaaatgtaagctgtcctctgatctggctgacaaactccataaatatccacgtttcatggtcactttcctctataagatagatgtccggcagcaaatcccctaaaacagaacgggctttcccgtatatattaatctcgaccttgtttttttcacgtgaagatttatacaccttcaatatcagcggaacaattccggattttttctttacaaacagtttataaatggcgcttctgtctgttgatttcaggcatgtgatgtcatccggattcaccgcggccctttcaccgaacgaatacgacagtttttcgtcaattctcagtttttgaaatgcgtcatacaaaagatccttttcatacatgccgatcttccttccgcttccgtttccagctgtttttgagatgagaccaagtgtttctgataaatggcatcgggtcattccaagcaaacagagcgtactctttttttcctttaaatcctttccaaaaatcccggaacgtcatttctcctctttttcgtttcttcaaaaacgttaagaagtaacgcacctcataaatccagttgattccgtctttttgttcgagctggggcttcacatgttgtccggtcaaatacagatagtacatgtaaacgaaatgaatgcctgccggttctgtcaggctatggctgagccaaaagcgcggattaatttcgataaacttataaacattgtcccgggggtcctttttaaattctgccatgcctactcccttcagctgaatcgcttcaaaaaacggcagggtcttctcgattaaatcaggaagccgtttgctgacgacgtgggcccccgcgccaaaatcagcagggaattgatggttcttttgcagagagaataagcccattaatttcatttggtcatcataaaaagtggcgactttataaaaacactggttgtctccggggatgatctcctgcacgagcagttctccattttctctgtaggagctgaactccttgcgcaattgtgcggcatccttcattacaattgcttttttgtttactttttttctgtattcatggccggccaccggttttaaaatacacgggaagtcaatattggcgatggcctcttccagctcatcccggttgttcggaaaaaaggttttcgggcaggggatgttatgcttgaccgctaattcatatgctttgcttttatctaagaccgtttctaacagagagcggctcgggagcaaaaataaaaaaaaaccggctaatgtctcgcggaatttagatataaatcccgcataatcatcagaacctgcatacagaaccggctttgcttggaatcgcttcccgaaatcagtcaggaatgtcagcagttcttcctcttgtgttaaagggctgggacatatcccgcaatctgccaatcttgattttccgatacgataaggtccctccgtgtcaaatgcgtaaacatcgattcctcttcgggccaggctgcgaatgatcccaatcccgtttgcactgaaatctagtacaacggctgcatgttcatgtttcatgatctccctccgagctgttggtattttgataaatcgattcgatattttttatcatcgtctcactgctcaaatatttctccgcgtaggcctttgcgtttgaagcagctatcttccgcgcagatttgttagtgataaaaaacgctaaagcccgggcaagaacctttgcatttcccggctcgacaataagccccgttttgttatggcggatcagatccggaatacccccgcaatcggtcgcgatgatagccgagccgctgaacatcgcttcaataatcgaaataggcagactgtcattaacggtcggcagtacgaatatgtccgtcatattcaaaatagcgggaacatcatctctttttcctaaaaaggaaaccatagatagattcagttttcgagcctgttcctctaaggcgctcctcatctctccgtcgcccgcgatcagcacttcaacatgctcaagtacatcagatggaattctcgaaagtgcgtccagtaaatatttgtgaccttttctcgggcctaatcttgcaatacacgagatgatgatcttatttttcggcagcgggatttttcttttcccgcctgtttttgcatcgtaatcgattcctgtgatcaccgttgtcatgtcttcctgttcggctccgagcttcatgagcgggctgcggaacgtatcgctgataataatcaggcgatctgcgtattcaatggctttcatctctagttttttataataaaactcttctaccgagccttttttaaagatgtgaaatttaagtctgttgaaagtaaacatgccatgcggtgtgaaaaataaaggtttcttatagatttgattgaacctgcctaacatattggctgtaaataaatcttgagcgtggaacacatcatatctttccaaatgaatcttttgaagcatttgctcgtatataaacatcagccgattatttttcaaaatatgatcgttataatccccatatctgtctttaaagaaatcttttaatttcggaacaaccgccgtccgcagttcttttacctgtgcggacggaaacagattaggggagatgacatcgaccttatgccctctctttttcaggccttcactaagcgttttaatatagtttgataaaccgcccgtgtgcgggtagtcccaaaacgtggcaatcaaaatggataacttcttttttttcctgtataaccgcggaatatgatgttcatgtttcaactgtgtctttactgccgcctttttttgagggcgcgttttgaccccgtagtagcggtcaagcgtctgaaccatatacggatacgggacggaaaatgtcttgatcatttccagatcctccgcacgacttcaaaagcttcagcgtattccacacccgccgtcatccctctgactcttcctaaatgtttaacgccttcatatgaacggggatgagggtaatccctcatttctacgtcatagtggtgaagcgccgcgagtttggcatccattgtgtctgtgatgttaacgaagtaattaggtttgaagagtttatcagccgtattcctctcccactcgcttgaagatagcgtttcgaacgtaagcagttcgataggcttttgattcggaagcggtctggcggctgttaaaactgcttggaatgttctctggtggtccatattgatatcgccgtaatgatgtgtaaagattttatcaggctgatagacgcgaatgagctgctctaattctttgacaagcttatgaagagggatacattccagctctaaattcgtatgctccaaaaagatgactttctcaattccaagctcttgattcgcgcgttcgcctaattgtttaatatgatgagcttcttcttttcttcctaatgccgtaataatggaaatcactttatatccttcattgatcagccgttttatggtgcccgctgctcccaatagttcatcatcgggatgagcgccgataaccataatgtattctgccattttttccacactccaccaaacaaatgttacaaatatcatatgacgaccctaaaaaaaggaaacttacatgtgcggattttcagaaacttacatgtgcggctgccattccaggtaacgtgacggatttaatttttttatagtattcaaaaactcatccgccaagccgtatttgtccagtccttttaatagttttacgggaaaccgggtaatagcggaaaaagctcttttatggtcgatgactttaagatttccgtgttcattgatcagaatgtgcctgatttcggcatcccatctggtaaaaccgattctttttaattcatccagcatatttaaaatatcagcagtcattttgacggacagggatttttcttttctgatatggcgggcaagagaggtgccttggacgtattccatcacaatataacgatctccgtattcatacagtcttggaatcaccggggaaccttgtccggtctttaaagccgccaattccttcttgcatgtccctttttcaaagaagtattttatgcatttgttgtgtgttaagcggtagacttccccgtcttttccgtctccgatcagcggataatgctccagcgcctttttattctccggattattaaaatatgtttcagaaaaaaatcgtttcataccgacacatccttcgttatgatgtaatataatatgcaatctggtaacgatcggaaatgaaacaatctcatcattttcttgcgctgcgccgtctgctgacatgaaaaaaacccgccggatcggcgggtttttcattgtgtattacgcttcttcttttacgtgaaccttcagaacagcctgaacttcagggtgcagctttacaggaacgtttgtatatcccagtgtgcggataccgtcttggagctccagtttccgtttatccactttaatcttatgcgttttttgcagcgcttctgcaatctgcttgcttgtgacagacccgaacaggcggccgccttcaccggatttggcactcagctcaacagtcagctgttcaagcgtttctttcaaatctttcgctctttcaagctcggcaatcgcttcttttttctctttttctttctgtcctttcaatgcgctgatgtttgtcgcatttgcttcgacagcgaggccttttttaatgagaaagttatgtgcataaccgtctgctacgtttttcatttcgcctttttttcctttaccttttacatcttgtaagaaaataaccttcatctctgaacgcctccctcaaaatattcatcaatggcttccttcagccggacgagcgcttctgatacagaaatgcccgataactgggttgccgcattggttaaatgccctccgccatccagcgcctccataataatctgcacattgacctcgcccagcgatctcgcactgatgcacaccgtatgctcatcccgtctggctaccgcaaatgaagcttccacttcactcatcgataagagggaatcagccgcctgcgcaatcagcacctggtcaaagtactcctcttcgttctcaggaagagaagcaatcgcgatatgttctttataaagagctgtatgctggatcagtttcgcccgcttgatataagaaccgacggattctttgagaactttctgcaccagaaccgtatctgcgcctttcgctctcaaataagaagcggcgtcgaacgtccgcgagcccgtgcgaagggaaaaactcttcgtatccactattataccagctaacagggccgtcgcttcaatcatattgattttgagccgcttcggctggtattcaagcagctccgtcacgagttctgcggtggatgaagcgtatggctccatataaacgagcagcgggtctttaataaattcctcgcctctgcggtggtggtcaatcacaacgatgtgctcgattttgttcatgagacgctcttccatcacaagggacggtttatgtgtatcaacgacgacaagcagcgtgtcgtcatttgaaatctccatcgcctcttccggcgtgatgaaccgcgaccacagctcttcatattttttaatttcttcaatcagacgctgaacgcttgatccgatctggttcggatcaatgacgatgtagccttctttgccgttggcctgcgccaccttcaatattccgattgcggctccgactgcgtccatatcaggaaatttgtgccccatgataatgacattgctgctttctgagacaatctccttgagcgcgtgagaaatcacccgggcgcgcacccttgtgcgtttctccatcggatttgttttgccgccgtaaaatttcaccttgccgttcggcattttgatcgccacttggtcgcctccgcggccgagagccaaatcgagactggactgcgccagatctccaagctctttcaaggaagaaaccgatgcgccgatcccgatgctgagggtcaaagatacagtatgaacggatgttttttctcggatttcatccaaaatcgaaaatttcgcgttttcaagctccgttaaaatgtgttcatttaacaccgcgataaaccgctccgaggacgtccgtttcaggaaaatgccgtgctcctgcgcccacgcatttaataatgaggtgacctggctgttcatcgtgcttctcgtttggtcgtccagcccctgtgtgacgtcatcatagttatctaaaaagatatatgccagcacggttctctcattttcgtactgcttttcaatctgaatctgttctgtcacatcaaagaaatagagcaggcgctcatctcttttaatcactactttaaacttccgctcattcaaggtgatcgtttccgaatcgacctcctgcttgatcagcggcacgacggcctcgcatgtgtcatacagcgagcgcccgacgagcgtgctttcattaaaacaggaagacaaaaacggattcgcccactcaatgtaatattgatcattaaacagcataatcccgataggcatttccattaatgcctcttcgcctacttttttcaatctatacgataacgtggagatataatcgtcaatttcttttctgatcagagaatccgcacgcttaatgaaaaacaggatcacggcgagcagcacaacgccgatggctcctatcagccagttaaagtaaatgctgatgaggattatgatgattgacaatgcaatcaatgcatagatgggataccgaaacaacggtttttcataaaaactaggcatttctatcaactccccacctgtaagtcacactcaatttcgcgtcaccttatttcttatgttaaagcctatgtcaatgatgcctaagaggagatacacggacaagatgagcggaaaaagcacacccagcacaattgctaaaacaggaacggctttcggcatctccatttcgcggcaatagaaaaaaataaacgctaacccttgaatacaaatcagcaagctgagaataaatcccccattcaatgaaaccgaatacagcatatgccctttttctaaaggcagaaaccctaatatcgtcacaataaaatacagaatgacaacgctttgcgggagtttgagctctctaaaaggcttcatcttcggaagatcaggggaaaatcgccgtaaaagcggccttgccatagcataactgaggaaagaaaaaacgatgccggtcaatacgagcactgtcggaaaaagatattgaaccgtgctcagctgactttccatcagcttgatctgcttcccgaactgatctccgtaaccgagctgctttgacatggtttctgctaaagacatcgactcccgaagctgggacatggtggtatcgatcacattcatattaagaaacacgatgctgaccacaaaaaaaacgacgccgcacagcacatacgccatagcgccggcagcaaccgcatagccgggctgtttctttttaaaataatatcccatggcgattcccgtacaggccgccgtaaaagcgcctgtaagcccggtaaacgaacctacaataaagctgacaggaaggctggcaagccccatccataccccgggcttcagaccgtgccgaatggtgtaaagaatgatcggcagcggcaaagcaaagagaagaattgcccccagtaaagggaggtacacgaccaaaagggaaatgattgcaaaaatactgatcaaaatggcgccttctattagagcccttgtatttttcacttactcacctcaaaccttgtatcattcgaacatacgaatagaaaagagcagcttagacgactgctcttttgacgccgcaatgtctctttcaagacctgaattttccataaactctccaaaatacacgtatatattttaacataagtcgaaatcgcaagtaaaatgagcgcggacagccgcaatgttccatgtgaaacatgaaaacagacaaacggacatccccgtgaaagaatgcccgttgtatcagtgatcctgatcatccatgaaaccagaagtatctctgtttttctttttggtttttcgtacatataacaagacgataacgataagtaagagagtggtcgcctgtaaaaccccgctgctgaaaaggaagaagttctttatcatgtcccacatatagtttcacctctatttcgtatttcctttacattgagtttccctttctggaaacttcaaaacatcaggaacaacatcgggaccggggcatatgctgaaagtgaaaatgaaggataaaggagattcttacactatgaccgagcggagaacattagcatggcatgaaacgttagaactgcatgagttagtggctttccaggcaaacggacttgtgaaattaaaaagaacagagcgggacgtaagcgatgccagattaaaacagctttaccgattttccatccattcgctggaacaaaatctgcgtgaactgcttcctttcttccctgaagctcccgcttttcgtgaggatgaaacagaagagcgcgctgattccgcgttttacagcggcggcctgctgagcatggccaaaacgtctgtgcgcaattacgccggagccattacagagacggccacaccccaattaagacacgttttcgtcaagcacttaaacgcggctatcaagtggcatcaaatgatctttgagtatatggaagaacgcggtcaatatcctgcttacaacctgagcgaattgctgaagaatgatgtgcgcaacgccagaaaagccatcgcgatgaaataaaaaaaagcagcaaggaatttaatcctttgctgcttcttatttttgagcggactgatcttgaggcgacgttttttcccggtatgtctcgagaaactcccggttggcatctccccatttcttcatttgcaaaacgatcggttccagcgacctgccgaattcggtaagagaatactccacctttggaggcacctgctgatatacctcgcgatgcacgatgccgtccgcctcaagctcgcgaagctgaagcgtcagcatacgctgcgtaatgctggggcaaatgcgccgaaactcattaaaccgcttttttccgccgatcatatgataaaacaaaatacccttccactttccgccgataacggaaagcgtcagttcaaccggacaaccttctttattcggatatatgttcatttttcatcctccatagtaccttttttgatactatatgctgattagcatctgacttacccagtattttactcgcaatcctcctcaccgctcaacaaaaatgcttctttttcacatcaatttttaaggttttgaagattacaccctccgcaagacgtgttaaactataaaaagattgtttacactacaaaaaaggacaaggagttattatggaaaaaattcttattttcggacatcaaaacccagacacagataccatttgctctgccattgcctacgctgatctaaaaaataaactcggcttcaatgctgagcccgtccgccttggacaagtcaacggcgaaacacaatacgcgcttgattatttcaagcaggaaagcccgcgtttggtggaaacagccgcaaacgaagtaaacggcgtcatccttgttgaccacaatgaacgccagcaaagcatcaaagatatcgaagacgttcaggttcttgaagtgatcgaccaccaccgtatcgccaacttcgaaacagcggaacctctttactaccgtgctgagccggtcggctgtacggctacgatcttaaacaaaatgtacaaagaaaataacgtgaaaatcgagaaagaaattgcgggcctcatgctgtcagcaatcatttccgactctctgttatttaaatctccgacttgcacggagcaagatatcgcagcggcaaaagagcttgctgaaattgccggcgtagatgcggaagagtacggcttaaacatgctgaaagcgggcgccgacttaagcaaaaaaactgtggaagaactgatttctcttgatgcgaaagagttcacgctcggcagcaaaaaagtcgaaatcgcccaagtcaacacagttgatattgaagatgtcaaaaagcggcagccggaattagaagcggctctttcaaaagtaattgccgagaagaaccttgacctcttccttctcgtgattacggatattctggaaaacgattcccttgcgcttgccatcggtgatcaagcgtcaaaagtggaaaaagcattcaacgtgacgttagaaaacaacacggcccttttaaaaggcgtcgtatccagaaagaaacaagtcgttcctgttttaacagacgcgattgcagaataaccaaaacaccccggcaaccagccggggtgtttttttctgctctttcatcagacgtccgttttgtaagcgcttactctaaaattattttgacgcctattaatatacaatatataatatatcacatgtaaggcgttcttttttctaattattgtaagttgctatcacaacatcagaatcgggggtgtctatcctggaaaaacacgctgctctttcttattcacgaacaacaggcatttggcttgtgcttacaggagctatcttatggggggtctcgggaacggttgcccagtatctgttccagcaccgccattttaatacagaatggctgacttcggtgcgccttctggtgtcaggggcgcttctgctcggaatcgcgtacctcaaagaaaaaggacggatatgggctgtttggaaagacagacaggacagaattccccttcttttattcgggattttcggaatgttaggtgttcaatacacctacttcgcggcaattgagcatggcaacgcggcaacagctaccgttcttcagtatttaggaccggcgatcattacatgctttttagcgattcgcgcaaagagaattccttcaggaaaagagctgctcgccgtcttattggcggttgccggcacattcattttggtcacgcacggtaatgtcggaagcctgtccatatccggtctggccgtcttttggggaatcagttcggcgtttgcactggcgttttacacccttcagccgcatcgtctgctgaagaaatggggatccgccattgttgtaggatggggcatgctgatcggcggagccgccctcagcttgatccgcccgccctggacatttgaaggcgagtggtcctttcctgcatatgccgcgattgtgtttatcatcattttcggaacgctcatcgctttttattgctacttggaaagcctgaaatatctgagtgcctctgaaaccagcctgctcgcctgtgcagagccgctgtcggcagcttttttaactgttatctggctgcatgttcccttcggaatatcagaatggctgggtactttgctgattttaaccaccatcgctttattatctatcaagaaaaaataacctctcttttttagagaggttttttcctagggccagagcaccccttaggctcaattacccatatattaaaaggccttttttcattttactatcatccaaaagaggaaaatagaccagttgtcaatagaatcagagtctaatagaatgatgtcgacaagtaaatcatgcaggattgttactgataaagcaggcaagacctaaaatgtgttaagggcaaagtgtattctttggcgtcaccccatacatattttaggtctttttttctgtaacaaacctgtcatccatgaatgcaggaggatcgaatcggcagatcgcaaaaaaaggtacatacaaaaggagacatgaacatgaacatcaaaaaatttgcaaaacgagccacagttctaacttttacgactgcacttctggcagggggagcgactcaagccttcgcgaaagaaaatacccaaaaaccttacaaagaaacgtacggcgtctctcatatcacacgccatgatatgctgcagatccctaaacagcagcaaagtgaaaaataccaagtgcctcaattcgacccatcaacaattaaaaatatcgagtccgcgaaaggactggatgtgtgggacagctggccgctccaaaacgctgacggaacagtagctgaatacaacggctatcacgtcgtgtttgctcttgccggaagcccgaaagacgctgatgacacatccatctacatgttttatcaaaaagtcggcgacaactcgatcgacagctggaaaaacgcgggccgtgtctttaaagacagcgataagttcgacgccaacgatgaaatcctgaaagaacagacacaagaatggtccggttctgcaacctttacatctgacggaaaaatccgtttattctacactgacttttccggtaaacattacggcaaacaaagcctgacaacagcgcaggtaaatgtgtcaaaatctgatgacacgctcaagatcaacggagtggaagatcataaaacgatttttgacggcgacggaaaaacatatcaaaacgttcagcagtttatcgatgaagggaactatacatccggcgacaaccatacgctgagagaccctcactacgttgaagacaaaggacataaataccttgtattcgaagccaacacgggaacagaaaacggataccaaggcgaagaatctttatttaacaaagcgtactacggcggcagcacaaacttcttccgtaaagaaagtcagaagcttcagcaaagcgctaaaaaacgcgatgctgaattagcgaacggcgccctcggtatggtagagttaaacgatgattacacattgaaaaaagtcatgaagccgctgatcacttcaaacacggtaactgatgaaatcgagcgcgcgaatgttttcaaaatgaacggcaaatggtacctgttcactgattcacgcggttcaaaaatgacgatcgacggtattaactcaaacgatatttacatgcttggttatgtatcaaactctttaacaggtccttacaagccgctgaacaaaactggtcttgtcctgcaaatgggtcttgatcctaacgacgtaacgttcacttactctcacttcgcagtgccgcaagccaaaggcaacaatgtcgtgatcacaagctacatgacaaacagaggcttctttgaggataaaaaggcgacatttgcgccaagcttcttaatgaacatcaaaggcaagaaaacatccgttgttaaaaacagcatccttgaacaaggacagcttacggttaacaactaataacaacaaaaagaaaatgccgatacttcattggcattttcttttatttctcaataagatggtgaattcaatcatggcacgaaaatggcccgttgtaatattgatctttttgggtgcgttcctgtttgtcggcttactgccgaacaaaaaccacaattcctctgacacaaacaacacggagcataagaaggattaccgggcggcgtatcattttacgactccggacaaatggaaaaacgaccctcaaaagcccatttttttcgagggaaaatatcattactactatctttataatcgggattacccgaacggcaacggcacagaatggcggcacgccgtatcagaggacttggtgcactggacggacgaaggcacggctattccgaaatacaccaacgaaaacggcgatatctggtccggttctgtcgtcattgataaacacaacaccgcgggcttcggcaaaaacgcgctggtcgccgtcacaacgcagccgacagccaaaacaaaagcccaggaacaatatttatggtacagcacggataaaggaaaaacgtttacttcctatagtgatcagcccgttatgaaaaacccgggaactaaggatttccgggacccgaaagtgatctgggatgaacaggatgacaaatgggtgatggccatggccgaaggagaaaaaatcggtttttatgaatcacccgatttaaaaaattggaaatacacgggcggttttatcactcagcagatcggcctcatcgaatgccccgacctttatatgatgcgtgcagatgacggcacagccaagtgggttctgggcgcaagcgcaaacggcaaacccgcaggcaaaccgaatacgtacgcgtattggaccggaaactttgacgggaaggaatttaccgccgatcaagaagaaccgcaatggcttgattacggctttgactggtacggcggcgtcacatttgaagacggtaatagcgaagatccgctgacaaaacgctatgcgctggcatggatgaacaattgggattatccgaatgaaacaccgacactaaaaaacggctttaacggcacggattctatcgtccgtgaaatccgtcttcagcaacaggacggcggcacatacagccttgtgtcagagccgattgaagcattgaaccaattaacttcttcaactgacagcatagaacacaaacaggtgaacggttcagagacactgccgatcaaaggtgatacatatcagcttgatatggatatcgcttggtcagatatcaaaaatgcaggcgtcagactcagagaatcagcagaccaaagccggcatattgatgtcggtatttcagcagaagacggctgtgcctatgtgaacagatcgtttacagaccagcctgataaaaccggcgcatacgtcgaaagcaaagctccatttgacggaaacaaagggcgcgtccatctgaaaattctagtggataaaaccagtattgaagtatttgcagacgacggaaaaaccgttttgacaaatgaagtgttcccaaaacacgaagatcagggaatcacactcttttctgaaggcggctccgctgactttcagcatattgagatgaagcatctcggctcgattcattcttagacgtccctcttcatttctaaccggcgcccggactgtggtaaaatgcaaatatgtatactacgattcatgaggtgttccattggataatcaaaacaaagaacctgtgctgaaaagaaccatcatgcgggacgaagtgtatcgcacactcagaaactggatcataacgggcaagctcaaaccggaaacaaagttaaaggacaaggatttgtcggaaacattgggaatcagccgcaccccgatacgggaagccttattgcggctggaagatgacggcttggtgataacaaaagcgaacagatggacacttgtcgctccgattgagttaaaagaagcggaaaacttgtattccatcgtctggacgcttgagaaactcgcattgcagcaagccctcccgcgtatggacgatgccgtgattcaagaattgaaacagctgaatgaaaatcttcttcaaacgatgaaagacggcgataaaatggccgttctggaagcggataatgcatttcaccatcgcatcattctgcttgcggacaacgctgaacttcacaaattgctagtaagcctgaaagtcaaaattcagagactggaaatccgctatttcagtgaaaacggcgctttaaacagatcatataatgaacactctgatatcattcacgcattagaacagcaagatgccgccgctgcttttacagcgcttgaagcgaattggaaaaacagtttagaacggctgcaaaacatggcatagcaaacgaaaaagccaaatcactcatatgatttggcttttttacggatatcacaagacagccgcgttgcctgtcttgtttactttttgtttatatataaataaataccgtaatccgtcggcacagaagcataccccatctgtctgagcatggctgttatattcccgcgatgatacgttccgtggttcacaacatggaggatcatatcggccgctgcggttttcatgatgtcacctgacggatgctctatttcaagggggaggctgatattttcctccttctgcaaaaatagttgataccggtctgataatttcaaaaatagatcttccagctcttctatctctttagacaagatgtcctctttttgctgttcagctgatttcagcgtatcctccagacgctctccggagaacacatcaaaccaccccttatccgacagatacacatgagtcaatacaccggctatcgacggaaagacactttgaatctccttacggtacacatcctccggaagctctttaagccgggtgaatatttgctgatttgcccaaagatgataatcatacaattgcagtgccagatgtcccacattaccctctcctctctcgatatagaacgtacgttcctaattatactacactacatgccgctctgtaccattttcttcattcgcagctgagaaaatccgataaaagccgaaattaataagagaaggcctgcgccaatataaataaaccgcacgccgaatacatccgagataatccccgttccgataatggaaaacataaaaatgaactgaactaaagctgatctcgccgctaatatattgacccgtgtcttttcggtcgtgatattttgaagtaatgtttcctgcgtgagatctcgtaatacacaagccggccccatacacagcaccagaaaaagggccgtaacggcgcttgtgatcagcccgtaaataaacgtgaacattccatatgccaaggctcccgtcagcataagcggaatgagatgatgctgaagcttaccggataacttatagatgatcagtccgccgatcatcgtccctgcataatagactccgttgacatacccccaccaagcctctcctttatgaaggacgtcatgcacataagttaaggacacagacccgatccatatcatgcctgcccacgattcgatcacatccatcacaatgagaaccttgagctgtttttgctgaaataaatacacccagccgcttgccgcatctgcaaaaagggaacgttccctgactgctgccggcgcacacatgcgtacttgaagaaacagaatgatgcccaacaccgaagaaaccaataacatgacagtgacgatcattgtatcgctctctcccaggaacgctatgatgacgccgcccagagaccaccccgcaaactgaacggtctgatccgccgccgataataaactgttcgctttcgcccttcgatcaggaggaatgatttccccaatcagcgcgctttttatcggagcaaaccatccgttgcaaaaagaaatgcctccgatcagacaaaacagcagaaaaaagaatgcggatgaaccggtttggatgacaaaaaacaaacagactaacagtgtgatctgtatcaattgagaactgattaacaaagaacgaagcgtgaaccgaccggtgaccagcggcaaaacggcgctgcccaatacgcggcatacaatgctgacgagcgtcataagagaggccatcgccgtcgaaccggtttttgtaaacaaaaacaagatgacggccatcgtataaagtgaaaaccccaagttgatagcggtctggctgtataaaatagcgtaatacgctctcttcatattcatcctctgcaaccccactccctgattatgtaaatcataccatatttaccgatcagctttttttaaaaaaacagattgacatggagtccactccatctattaggctttattagcagatagaagactttcagcaaataacaattaagaaggggtgacagctgatttgacatccccaatctatagtgatgtatataagaaatgattttcaaaacagaataaaaaaagagggcttcctttccggaagccctcactcactccgtctgctacgccaataaaagaaaaataagcgctaaaacagccggaagtccttgttttacgataattgatttgtttgaagtaaagcctccgaaaatggccgcgatgaccacacagatgacgaaaaacatttgaatcatatggccaatcggatcagctccgaggatcagtccccaaatgaggccggcagccagaaatccattatacagaccttgatttgcaaacatgaccgccacattccgatcgccttctaaatgcttcggcaatttgaaagaccgcttggcagccttcgaattgataaaaaacatttcaagtatcatgataaatatatgttctaaagctacaattccgacgaaaacagccgcaattatgtccactgtccctctcctctcagcttcacttcaaccttatttccattgtgcgattgtttcgataggaagacggtaggaagcatatccttcgtctgccgcttttccgattgataacagcatgaccggtacataacgctctttatccattccgaaaacctcggcaatcttttctttatcatagccgccgatcgggtttgtatcatagccgtgcgcgcgtgccgtaagcatcagctgcatggaaacaagacctccgtcgatcagaatcgtttcacggttcacttgctccggcagtttttcaaaatgcgccgtcaacgcagcgatttgtctgtcttttacttcctgcggcatgtagcccagctcgaccgcttttgaataaatttcttctaaatagtcatcactgttcatatctgcgaaaaccgcgatcaccgcagatgatgtgctgacctgtgtttggttaaagctggcaagcggcgcgagtttttcttttccttcagggctgtcaatgacgaggaaacgccatggctgcgcgttaactgaagacggcgctgtcgttgcttcttccaatatttgagtcatttcttctttgctgatttttacagccggatcgtaattccgaatggaacggcggcctttcataatgtccataaaatcgtttgttttcagttctgttttcatgtgtaatacactcctatgctttcatattttctatattattctgcatctgcgacaatacgttttttaacatactgcgttcttcctcgctgacaccggcaagcatttcctttatgaaacgctccttctcctttttggaagcctcaattctctcccgcccctgatcagtaagccggacaagtataattcggttgtcctcaggcttccgccttcttgtgaccatttctttggcttcaagctgtttcaagtgtcttgtcacagctgcgccgtcaatattcacctttttctgaagatcgctttggctgatctcatcgacgtaaaaaagcacggcgagaagctcaaggcgggattggctgattccggtgcacgcttcaaacttcgtgccgatcactttgtgcagtgattggagctgatacaaaatctcgccttcctctgaacaacatgctgtcaaaacccatccctactttcttttgcgcaattaattgactagtcaatgtttgatatatcaataatatacatccgttattctttttttgcaagtgttttctcctttttaaaaaaagctgccggtgaacggcagctccttcttaatgattatggatttttctgaaattactgccttttacttcagcgacatcatataccgtcacaaaggcttgattatcaatgtcattaataatttccttcagtttggtttcttccaaacggttgatgacacatgtgatttctttgaatttttcatgagaaaaaccgccgtatgcttctttatacgtagcgctccggcccaattcttcacgaatggtctctaccattaatgcaggctcgttggtgataatctgaaatgttttagaaccgcttaagccttcctcaaccacatggatcaccttggatgcgatgtagtaagcaatgacggaaagcaatgcgccttgcagcccgaatacaaaagaaacaaaaataaacacaaaaatgtttaaaaataaaatgagatcgctcgtgccaaacggcaatttccgtgacagaagcacagccagcatatcaattccatctaaggcgccgccgttgcgcaatgccaatcccattcccaagccgagaataatcccgccgacaacggtgattaacagggtatctccctcaatgatagccggcgtgtggtggaaaaaactcgtgcccgcggcaagtgagacaataccgataattgatagaaacgcaaaacctttcccgatttgcttatatcctaaccagacaaacggtatattgatcaccgcaatcaagatcccaagaggcaaatgaaacagctgtgaaccgacaatgctgagcccggttacaccgccgtcagatacactattcggaatcagtacggtttccagtccatacgcggcaataattccgccgatgatgaccatgatgacccgtacgattgatttggctctgaatttcttacgtctttgtttttcgattgtactcatatcattccccgcttcaattattttgtcttatttaaatataccataattgatacttttcgttaaaaataagcctatcggctagttgaagcaggaaccgaggaaggagatttcacagataacgtatccatttatgactttaatcattcacaacgcaatcattcagtaaaaggaattatcatccattaatagtctcttttgtttcccttcttcacatattcccaatcatgctctatattttttctcacccgctgaagaaggctgaaaatggtttctttttcctcagacgtaaagccggacagtgctacttccgcagagtgctctccttctctttgcaataacggataaacctttctccctttttcggtcgggaacagtttttttatttttttattttgatcatcaggacgcttttcaacaaatccttgtatttccagttttttgatcgctctcgccgctgttgttcggtcaactttaatcatttccgccagtttttcctgtatcactcccgggttttcacatatacgcacaagatagagatactgcccttttgttaagtctaattctttaaattcaatattgctgatggaatccaatgcccgtgcgatcatgccgatttcacgcaaaatatcagtcatatcttttcaaacccttcatatttttgttgcacttgcaatataaatgtttcgtcgttacttctataagaccacaagcaagccgtgcagtccagactaatatgtgaaaagggttggttgatcatgaggatacaacagaaattgatttacaagcagcgcttgagattagaaaagcagtattcattgaggaacagcaagtacctgaatccgatgaatttgatcagttcgatgcgcttgaggaacagtgcgggcatgtcttggtttatcatgaaaatcagcctgccggcacaggacgcgtccgcatcgtaaaccaaacaggcaagctcgaacgaatctgcatcctgaaaccttaccgtaaatacgggttgggcaaagtaatcataagcgaatgagaaaacatggtaaaagaaaaaggcatcacccaatgtaaactgaatggacaaacacatgcggaaggcttttatcacatcttaaatagtccgattaaaatctattaataattaacagttgaagagatggtgaaaaaagctgattctctctattatggactcctgccgcgttacattttttctatcttcacatatctttactattaagtacgtttaaattgatttcaggaggagatatgaagtggaagaaacgagtatggagccatcacgactctgcaaagaatttgcaagaattctcaattcaacgcccagtgtcgtaaatggcgtatgtacggcgacaagatttcgaagcaacattcacccggtggtactcggaagaagagccgaggcatttccttttattcctcaggccttttcatttgagagcatggactcggaaggcagagccttatgtttaggtgagactgttttactgcaagaagaagtgaacccattaatgagtgaactgcgcaaattcggtatcatcgtaactgccgttcataaccattggctgtttgataaaccgcgtctgatgtttatgcattttgaatcaattgacaaacctctcaattttgcaagaaaagtaagagaggccctaagagttctgactgctaaaactgtgcgtgcggtaccaaaaactgacggggaaatgattgaacggcatggtctttgtgacgaattcaacgatattctgggcggaaccatgcatacgtttgaaaatggaatttgtacagtaatgagatcacgaacgaatataaaaccggttgtactgggacggcccggaagatcatttttgctcattccgcaaatgttttcatttgaatcaatgacaaaagacggccgtgctctttgcagcggagaaactgtaattctgcaaaaagaaatcaatccatttatcagcgctcttcggaaacatgatctgattgtaacgtctctacacaatcactggctgtttgacaaaccgagactgatgtatattcatttcgaagcgattgataaacctgtcaacttcgccttaaaagtaagaaatgctttaaaagtgcttactgataaagaggtcgaaggttagcatgtttcttagtatcaaaaagcgattcatataatcgcttttacatatgatcagccgaaaacaaaaaagaggtcagacatttgtgttaaaaaacagccttataggctgtcgttttgtgtatattctattgatgagtttatactacttcatcccgcattccatacaagctctttatttctcaatggctttctacatgccgctgtgcaaacaccttcttagccactgaaagagcattaagtacacgcgggaagcctgtataaggaaccaattgggtgatactctctacaatctcagtcggtgttaatccggatgtaagccctgtattgatatgaagttcaagctgcggctcggttccttgcgttacaagggatgaaatggtaacaagcgcacgttgttgattggttaatcccggtcgtgaatatatatctccgtaagcaaattctataatgtacttacttacatctggagcgatatctttcaagtcttcagaaatctttaaatgcgtagagattttatcatcgcttgttaaagtgtactccattaatttgtctaaaccttgctggtaacggctttgatccatttgaaattcctcctgaaaggtacttatttcctgacataagataatatatcgcagccctctctaaccgtaaaatacataaaaactataaaaaccattcatttttttcatgagtgatcttagtctacgtaattactcttacaaaaagatgaaatataccggataaattcgcgtactgcgtgtgaaacgtattttcctttttttaaaataatcgccactttccaaggaatggatggattgacaatggagattgccttaactaaactttgatcagtctttttcactatcgactgagggaaaatggaaatacctagttcttctccaatcatttcgctgataaaatcccattgagaactttcataaacaatatttggacgaaaaccggctctaatacactcctgaataatccgatcgtgaagagaaaagtcttcactaaacaggatgaaaggttcatttttcaagtcttgcatttccacaatctctttatgaacaagcgggtgagcgaaatgaacgaagagcatcagttcttcattaagcaatggaatgatatcaaactgctctttgtccactggttcaataaccacgccaagatccagtactccatcttcaacctcctgtttcaccttgtttcctccatgttctatcagcttgatgttcacatcaggatacaattgtttaaaccctctaatgattttaggaaaaaacaagacaccgatcagcggcggtattccaattttcacttttcctttttttaaatgcaaaagatcgtataagttcgtcgacaagtcatctaatgacttcataatcatttggccttgctcaaatacaatttcgcccgcatctgtcaaagcgatttgtctagcggatcgatcaatgagctcaacctttaattcctcttccaaacttttaaccatcttacttaaggcaggctgtgacaaatgcagattttctgatgccttagtaaaactgttggatttagcaacttcaagaaagtatgtgatttggcgtatatccatcgtatgatctccatttcatgagtttaacgaatacattatattctttttattcattttacttatacaactgccgggtgtaaacttttaggagaccaaaatgtttcctggaggggttactatgagtaaattattagaaagtaaagttgctcttgttacaggcgcggctagcggaattggtttagaaattgcacgtgaattcgctaaagaaggcgcaaaagtggtaatttccgatttgaacgaaaaagccgtgcatcatgcagctgaggaacttaagggacaaggatatgaagtcctgcctgcggtttgtgatgtaacaaacgaagaacaagttgaaaaaagtttctctaagacacttgaaacctttgggcgaatggatattctggtaaacaatgcggggattcagcatgtgtctgatatagaaaacttcccgactgataaatttgaatttatgctgaaattaatgattactgctccttttagtgcgacaaaaagagcgttccctttgatgaaaaaacaaaaatttggccgcatcatcaatatggcttccataaatggtttaattggttttgcagggaaagcagcttattgcagcgctaaacacggtttgatcggtttaactaaagtatcagcattagaaggagcggaatacggaattactgtcaatgccttgtgtccgggatatatcgacactccattggtacaaaaccagttacaagatattgcagagactagaggcatttctatagaaaaggtgtttgaagaagtcatttaccccttggttcctcaaaaacgtttgttagccgtgcaagaaatcgctgattacgcagtattcctcgccagtgacaaagctaaaggagttacagggcaggccgtcgtaatggatggcggctatacagcccaataatctaaatttcatctgcaggagtaatagcgctttggattaagtgatttactcttcaagaaccaagccgatggttttttaggaaagacatagctatacagattgaagtttgatatatatttggtatattaacttaagaaaagccgccctgttggcggcttttttatcctgcatcctgtaatgtgaaaatgtgaaaaagcaacggaatagttgttgtcttgcagaatgcgaagaagctgttggagctttcacaaagtatgtcggtgaagctgcagataagtgtgtaagattcccctctccccataatgcgcccgcactttttagaattaatactattctgtttcaatttatcttcaatggttgtctgttatatcaatctgcaattaaaaatcaaagtttttcgggaaatatttcattaataaattacggttataaagtagtgtaattcttagttcttagtcatcataaaattgaccttcaaatgcatatttaaaacaaatctcaataaagaccggtatattaacttaaataattttgaagacttctgctagtgacggttttaaagataatctctctcttacagctctttgaatatcaagttgtcctaagtattttttaaccagcaccccaaccgtagtcagcgaacaatccgcgtgtcattggtgtcatgtctctttctattaaagtaatcatgataaatttatctgcttgccaattccttaatcatcaaacccaattcataaattcccttttgaaggtcttcaagagatgcataagcatatgataagcgaatataattccctttttcctcagcatagatactgccgagattgagcagaatcccttttgataaggctttggtataaagtaatttcatggatatggaaggcaatatttttacccagacaaagaatcctccctttgggatattccatgtcgccacatctttcaaatgagtttctaaaacactcaaggccaattctcttctcacctttaattgacttctcacctgttctagatgctgctggtattcaccggatataaaccactctgccgctactctctgggataacgaactggagccgtaatctgtttgcatttttatgtcggataaacgttcaatcactggttccggcccgacaatccagccaatcctcaagcccggacttaatgttttcgataaactgcctatgtaaagcacatgcccatttttatctattgttttaataggatccgggggaatctcatctatccataactcacgataaatgtcatcttcaataatgggaagctgtgtattctcacttgccgcaaggatttcttctcgtctcttttttgacattaaaatacctgtcgggttttgaaaacaaggatttgtatataatatagccctcccccgttccccccttgccatgcggatatgttccggcaaaattccatcatgatccataggaactccagtcagcttcataccggctgattgaaatacgtgtaatgaataaagataggaaggctgatcaagataaacggtcgatcccctttgtaaaagccccattgatataagctgtaaggcttgcagtgcgcccgaaacaataagaatggaagaaggagaagcttgaatgccgattgttcttaaatagccgcttaatgcctctctcaaaggcaaatatccttttggttcctcatatccgaatgcctctatgttttgagatacctttcccatgatctctttcataacagctaaaggaaaaatctcatgtgaaagttctcctttactgagctgtataagatcagaatttgattctgatttattgatctcttgaacgattttttggcttggctgctgaattccggaggttacatactgatcccaatcgggagcggaattcttagccaaaagtgtccatgtattgttcgtaacaactgtccctttgcccattctgccttcgattaatccatccgccgtcaattcctctaaagctgtaatgactgtgctcctgttcacctcaaagtgtttggcaagcgtgcgctggcttggaatcttacttccgatcggccattctccatttcctattttctcttttataaattgaatgatttgtatgtacttaggaagctttctcatctttttttcttctggagcgctcattaaaagggtcctccttaaagtggttgggtcaaaatctatttaactggttgaagtcatctcatcaaatctttattaatatagaaaaacattaaataactggttggtttttgtaaagaggagtgagaaagatgagaaagaaaacagttcgaatcggcatagcttacagtctgatgattgggttgtgggcatcagctttcccgggaattcgcgcgggtcttgagagttacacgccggaacaccttgctttgtttcgcttgttgattgggtcaatggcattgttggtttttgctgttttgactcatatgcgtttgcctgacatgaaggatatccccgctattttatcgttagggtttttaggttttgcactatatcacattttgctgaatatcggagaaaaaaccgtcaacgcaggagttgcgagcttactcgtgaccatgacacctattttttctgcaatgttatcccgtctgttttttggtgaacatttcggtttttataaatgggtcggctctatcattagtttattgggtgtatcgatcatttctttcggggcaggaaactatacaaattcagtgaacggcattttgttaatcctgctggcagctttttcggagagtatttatttcgtttttcaagcccgctatataaaaaaatatggatttatcccattcgttacattcactatttggggcgggacaatacctatgcttgtatttctgcctggcttaggggaagagtttttgaacgcttcaatgaactcaacattgtctatcgtttacttaggcttattaccaacggttgtgccttactttgcacttgcgtatgtcacttcactcgtcggtgcttcagaagcagccatttcactttatttaacaccagccataaccttggtcatttcttgggtgtggttaggtgaagtacctgcgtttattgcactgacaggcgggatggttacagtcgccggggtgtgtttcacctatctaacagtaaataaaaagataaagattttaaatccttatttcttatctaaaaagcaataaagcagatgacatttaaccctgaaaatagagtcataagcagttctcctttttaatacttgggtttcgaaggcttcttctccccaagggtgccagtttacggggttgtgggcgttacctttgttcaagaaaacttgttgcaagcaaattcccccactcccgtaaagaattttgaaaacttacatggcagattgaacatttcttgacaaagttaaaatgtaaaaagatacaaagtgtctattgattaaattattcttttcgtttttattgcggttattgtatgtcttgtgtttcttgacaggtttttcattttcacaaataaaaaaacacgctggaaagatgctctaacgtgtcatgatttacttcaaatgagatattgttcaacccattttcttgcaatgttttaatgttgtttactaaatcgggtaattcagcaactgctgattctaatgatgccactccaattacatttattttccttggattcggtgcgtcgagatctaaagggacgtcctcattggcaggtattaatccgggttcataagcaaaagaaagactttgagcaattatcctcttcactccaatttcatgacacgcatcaacagtatttcgcgcacctataattctgattctcgctttttcttcaagattgtaacctgttaaagaggtaaactgatggacaacaacctcaggttaaattttcctaaaagcattaagaacagcatctcgatccattgcatctgcttttacaggagttacccctattcttttgaggaacgtgttcgaccggttacctcgggtcaatgcaaatactggatagccgttttgtattaatttaggaagaagggaccgaccaagcaacaatgatcttcatgctataccttatttacctgccaatcttgaagcagcttcttcaacttctttatttgctttttgtaaaacatcctccggactcagtaaagctgttccttgcactcggataatttgataatcctcaataccgaggaaattgaacattgatttcagatatttatttgagtattcaacttcttcataccagtcatcatttgtataaattgatccgctagcttgtatgacaagcattcttcgtccatctttaagaagacctactgacccagtgtcagtatatttaaatgtttcacgtgcgatcataatattgtccatatagtcttttaattttgatggaatattgaaattatgcaaaggcaaaacaatgacatacgtttttgcacttttgaattgtttcaatacttctgtcatgcgttctgttactttttgttcatcgcttgtcagttcttcgccttttcctgccttatcccatgcacttaaaactgttttatcaatcataggcacatcatcactatataagttaatttgctcaagctcttcactctctggaattaattctttgtaagcctctaaaaagtggttcattacccgtaaactgtatgatgacgtatcatctacttttggatgtgcgttaatgataagtgttttgctcatttgaaactctccttttattttatattaaagactatattaatcgacgattaacttggtcactaatataaaccttgtattttattttgtcaaacggaacaaatagtatctgaagaagggttttaagattgactatcatcaaaaatactcctaagatacaatgtgataaaccttaaaatcaaaagcaggtgagtttatatgcagtacagtgttggggttgaatatgctttacattgtctggtttatttaatagatgttccctccaaggaaagtgtcgggattcgggaccttgcagagttccaaggactttcagaaacatttctttcaaaagttttcggtaaattatctaaagctggtattgtaaattctgtccctggtgtaaagggaggatataggttagcaaaatccccggaggatatttccttttgggatgtaatagaggctgttgaaggaccaaaacccatttttcaatgtaaaaatattgtaagcaatggtctgctttatcgagacaaatgcaactcttgtgaatccagcaattcttcttgtacaattaacttggtaatgcttgaagcagaagaacagatgcgtaattatcttcgtaataaaacgctcgcatggttaaataaagaattggacgtagtattgcctaaaaaaacaaggacagatactcgggaatacttcataaaaaaaaagctctgactaaattaattagtcagagcttttttgtgcttcaagatgccttcggagaatttttacgaaagtatggacgagacaacaaaatgaataaaactacagattaagtttaacactccgattcggagagtcaaaggttaatgttcgcctttttgttctactttatgaaagggtcagcaattgctgatattataataattaatcaactctttgtggaatggatgataacaaatgacattaggccaaagattaaaatgggctcgaaaaaaatccggttactctaatcaagacgtgacagcagagaaaattggattaacagggtagacattgtctaattacgaaagggattatagatcgcccgatccggagacattaaagaaactcgctgatttatatgatgtatccactgattttttggtcggtagagaagaaaaggacagacccaaatctaaattggatcaaacagtcaatgaagcaattgaacaacttaaaaacgaagagacttttcatgaaagatgatgacattcaaatattatatgactataaataaaaaagtgaggttttatagacctcactatcaaacagttcactactcaattattttttcattgtttgttgttgcgcttgcgttttcaacactatgtgcttcaccatgaccaggtccaaaaagatttaatattacaactcctacaagtatcaaaacaatcccagtaacactggcaatgttaattttttctttccaaatcaaaatcgaaattattgtagtagcaatagtccctacaccagaccaaactgcataggcggtattcaaaggtatggacttcattgcaagtgataagaagaaaaaggaacctataaaagcaataattgcaccaatagtagggtaaagtttcgtgaagccttctgcggccttgagcatagaggaaccaataagttcaccaaaaattgcgagcaataaatataaatatgccattgttaattctctcctcctgtataaataatcaacgtcttataaatttgtactaaacctctataggtttgtttcattatttctttattagttacaactttacaagaaatagcaaatgtttataagtctttattttgcaaaaaaattgtgcgcaaaatgactggtgttccttagacgagtagataaaatctagtctagttaatctaataaggtataaactaaactccattatggtaaagtaaaaatagcaaccaatttaaaagtgaaagaaggtgagcccatgccaaacaataataaacccaacagtttaatcacggagaagtccccctatctgctccaacacgcccacaaccccgtaaactggcacccttggggagaagaagccttcgaaaaagcgaaacgcgaaaacaagccggttcttgtcagcatcggctattcgacttgtcattgacgccacgcagattaccatataatcctctccaattccctccattaaaatttttctatccagaggggatgctttatctttaaattgctgaatattataatgttgataaaaccattttttacaggtttattaagacaaatgaaagcagaaggattatgatcatgaagaattttttctctatcggagaggtatccaggttatttcacgtcaaaatatccactctcagatattatgatgagatcggtcttttgaaacctgcatacaaagacaagcaaaataactacagatactattctacagagcagtttgagagactggatacaatcaaatatttgcgggctttaggcttgccaataaacaaactcctagatttttataattcccacaatgcagataccttaattcaattactgaaaaaccaaaaaaccgaaatcgatcgtaaaaaaagggaattagagcttattgaaaaaaagatcacccgccgtttaaacaaaatagaagatgccgttaataaaccgttagacaaaattacaaaaatcaaacttccggagttgcgtgtcgcttatttacagcatgagtatattctaggtcatgatattgaacactctctaacagaattgagaaatgatcttactattaaagaagacatatttttaggaaagattggattatcgatttcagtgtcaaacctaaaagcgcataagtttgatcgttactccagtatttttatgatcttagaagacgagcatgatttgcccccatcagtaatcaccttaccatcaaatgaatatttacaaatcaggtttaaggggtcgcataaagaggccaaacaatattataaaaagttactgacatatatgaaaaagcatcatctggagttagcggccgactccattgagataacgttaattgattatggtgttactaataatccggatcattatgtgaccgaaatcatgctgcccattaaataatcccttgactctctagttactggagagtttatttttttaaaagcacactttattgggggagaaagcacatgattggaacaatttttaacacatttatgatcttcgcaggatgtttactcggagggctattcaagaaaggaatgaaaggtgaatatcaagatattcttatgcaagcgatggggtttgttgcagttggattaggaataaacgccattacacagcatttatcggatagtaaataccctattctttttattgtaagtttagctgttggcggactacttggacagtttgtaaatttggaacttagattcaaccatctagtcagcaagttctctaaaaataacttagctgaaggcttatcaactgcaatcttattgttttgcatgggatcattgtcgatattagggcctattgaatccgcgatccatggtgattccacttatcttcttacaaacggtatgttggatggcatcacttctattgttctcgcatcagcgtttggctttggaatagccttatctgctgttgtgttatttgcctggcaaggctcactctatttatttgcaaaagtaatggagagtgcattaagtgcagacatgattaatgaaataacaattgtgggcggaatactgatactaagctcggggttaagcattttgggaattaaaaaatgtaaaaccttaaatcttctgccatcacttatcattccgcctgttgttatctttgttatgaaagcttttggattaggcgcatagctctatatcagttgtcaggcaccttgtccattctgtcaactacagactagttttctttagacagaaacaaataaagaatagactgcacatctttatggtacagtaaagatatatcaacggtaatacgaacgaaagaaggtgatcccatgccaaataaaaaagtacccaatagattaatcgacgagaagtcaccgtacttactccaacatgcttataatcccgtggattggtatccttggtgcgatgaagcatttgaaaaagcgaaacgagagaataaacctgttctcttatctattgggtacgggtagcttagcgaacttgccattggtgccatgtaatggctcacgagtcctttgaggacgaagagatcgccggtatgttaaacgataaattcatagccatcaaggttgatcgtgaggagcggcctgatgtggattccgtgtatatgagaatctgccagctgatgacggggcagggcgggtggccgctgaacgtgttcgtcacaccagatcagaagccgttttatgcggggacgtattttccgaagacgagcaaatttaaccgtccgggctttattgatgtgcttgaacatctgtccgaaacgtttgcgaatgaccggcagcatgtcgaggatatcgccgaaaacgccgccgctcatcttgaagtcaaggttcacccggctgagggcatgcttggcgaacaggcggttcatgacacgtatcgccagctggccggcgggtttgacacggtgtacggcgggttcggccaggctccgaaatttccgatgccgcatatgctcatgtttctgcttcgctactacagctatacgggcaaggaacaggctttggccggcgtaaccaagacactcgacggcatggcgaacggcggaatttttgatcacatcgggttcggattcgcccgctactcgactgataatgaatggctcgtgccgcattttgagaaaatgctgtatgacaacgcccttctcctgaccgcctatacggaagcctatcaagtcacgggtaatgagcgctacaaacagattgcgatgcagatcgtaacgtttattcagcgggaaatgatgcatgaagacggcagctttttctcagctttagacgctgataccgaaggccgtgaggggaaatattacatatggtccaaaaaagaaatcatgaatcttctcggtgatgaactcggcccgctttattgcaaggtgtataacatcacagatcaaggcaattttgaaggcgaaaacatcccgcacctcattttcacgcggcgtgaggccatcctcgaagagaccggcctcaccggacatgagctggccgaacgccttgaagaggcaagaacaaaattgctggaagcgcgtgaaaacagaagctatccgcatacagatgacaaagtgctgacctcatggaacgcgctcatgattgccgggctggcaaaagccgcaaaggtatttcacgagcctgactttctcagcatggcggaaacagcgatccgctttctcgaacgtcacctcatgccggacgggcgcgtcatggtccgataccgcgagggcgaagtgaaaaacaaagggtttatcgatgattacgcttttctcatctgggcttaccttgaattgtatgaagcgggttttcatccgtcttatctgcagaaagcgaaaacgttatgtacaagcatgctggagctgttctgggatgaacggcacggaggttttttctttacggggaatgacgccgagactcttcttgtcagggaaaaagaagtttatgacggagccgtgccttccggaaacagcgcggctgccgtacagctgcttcgcctcggccgcctgacgggtgatgtatcactgattgaaaaagccgaagcgatgttttccgtgttcaaacgggaaatagaggcctatccgagcagcagcgctttcttcatgcaaagcgtactggcacacacaatgccccaaaaagaaatcgttgtgttcggaaggaaagatgacccggacagaaaacgtttcattgaggcgcttcaggagcatttcactcccgcctatacgattctcgccgcagaacatccggatgagcttgccggcatttctgactttgccgcgggttatcaaatgatcgatgggaagacaacggtctacatttgtgagaatttcgcctgccggaggccgacgacggatattgatgaagcgatgaacaccttacaaatcagcagcagagcctaggcggcctgctgcttttcttttttcacaaaacggaatgcgagccatgcgaagatgatgttgatcaccagagtcgatatgcaatcgtatatttcatagcccccggctgctgttgtaaataccgacggaatgccgccgtacaccgaatgatcctctgtgagaaagataaataaaaacatattattggcagcgtgaccgccaagggacatctccagactgcccgttttaaccgtgataaaggtccaaatcatgccgatggtgacatatccgattcccgcccatagagccccattttccatctccggatttccgaaatgaagtgcgccgaataatccgccgataatgaccgtcagaaccaccgcgtttgccgtcaattttccggcgaactgtagcagaaaaccgcgaaagagaaattcctccgcagaggtttgaatcggcaccaacaagacggccgccgctagcagcagcagaaaacgtgaagcatggaattcctgaagcgtgaaacgatccggatgaattaaaaaatcaatcagccccgcgacaaacatcagcacaacatatgtgccgaatccaaagaaaattctcttccagttcagcgactgattcggtgtaatgatggataaaaaccgccgcttcataatgaaacaaaccgctatccaaatgcccggaatcgctatgaaatagacgatatgctgtaaataaatatccgccagcgggtcacttaatgccgcctcatcccaatttatcgtcagtgaaggattgaaagcggacgtgagaaacatataaaacacggtcagtatgcttccgaaaaagaacaaacccacaatgagcaacagagaaagaagatatctcgatacactatttcttccctctgcgggccgtacaaatgtattcatatttatgcatcaacttcctttccttcaacattttacaatataaacagaaacagatataggaaatgttatatattttaagaagaaagcgctatgccgtttcctttggctctggttatttacactctgtttttgccaaaaaaagacctttataatgtattcgtcagataaatttacagtattttctgattacaattgctaagtcagggggttttttatgaaacatcagacattctcaaatgtagcgaaccgattagaccgtctccccatttcgcgtgtgcactatcaagtattaaccgctctcggaatcatctattttttcgatctcgctgatctgtttacgctcagcaacgtggctccggcgctgattgagcattggggcgtgaagctgtccgtcattgccgacgtcacagccgcatccttcctgggcatgtttttaggcgcctccatcggcggaagactgtccgatcggatcggcaggaaaaaagcgctgaattgttttgtccttgtcttttcgatctcatcttttctgaatgcgctggcatgggacattccgtccttaatgattttccgcttcttgaccgggctcggcgtcgcggccgccatgattgtgacgaacagctatttggcggaattttttccatcatccgtacgaggaaaatacatctccttttgcgccatgatcggactgatcggcgttcccgtcacaaacgttgtttccgcttttgtcattcctttaggctcatgggggtggcggctcgtattcgtatggggggcggccggtctcatttatttcttttttatccgccggcttgaggaatcgccgcgctggcacgaaaatcggggcgcatatgatcaggcaaacgccattatgaaccgtcttgaagcacgtatagagaaagaaaaaggcccgcttcccgcgccaaaagaggcggcagaagtacatacagtgaagcacgcaggctacttagggctgtttcagggcaggaatttaaagatcaccatcatcctgtcagcggtatggattcttgaaacctttggcttttacggctttgcttcatgggtgcccagcctgctgaaaagcaacggcatcaccatggaaaaaacgctgtggtacaatgtgcttcactctgtcggcgcaccgcttggcgcattgctcggttccatgatatccgagacgttccaaagaaaatggattctggccgcaagcgcttttctgactgccattgccggactgttatacggcatgacgtttattcccgtcatgattattgtgtttggatttgtcgtcaacgtcacggaacgggttttcacctcaaacttatacgcatatacatcggagccgtatcctacggaatatcgctcggccgggagcgggctggcatacgggctcggccgtttttccaatatattcggctccctgctcgtcggatttattgccgttaagctcgactacatcagcgtctttttgttcatcggcggctgctggcttctatgttccgttttgttaatcctcttcggtccgaaaactaatgctcagcaaatttaatcaataaaacagtgcgggttcccccgcactgttacactgtgatttctatcaaattgccttccccatcctctatcacgctctcataatatccgtcacccgtcacgcgcgggccgcttacaacctgaaatccgtcatttttaaacgtctccgtcaattcattcacccgctccttgctgcctgtagaaaatgcgagatgcgcccatccggtcatattctgtgacggagcttcatcaatgccgccttttttcataagttccagcctgcatccggagtcaaacgaaagaaaatacgatttgaaatcttttttctcattatgataaaggtcattggccttggcgccgaagtatttctcataaaattctttcatccgttctaaatctttcacccatatggccgcatgttcaattcgcatatgtccgcctccttttttttctcaatctagttataaagcatgaaacccatttcagctcaagactttttccgctgaaattgatgcataatttgttttttaaccgtttctccgtgcaaaaacagcaaaaatgcttcccttccgacccgttccaaatgaagttccagagatgggatattcaatgcccggctgacgctcaggtttccctcgccgatgatctccgcatcccatttctgttctttcgcaaactggtacaagccggcagccacgtcatcactgtgcgcatagatggccgtcggcgccttgtcgaaaccccagaagtgttcacctgcccgctttccgtcgtccatatcatggcatccgatcagaatgcgggtttcatcaagagagccgaaaaccgccttatatgcggttaccttgtcggccgtactcgggcttttttccgcttcccgcacacatgtaaaagcaacatcttgatgcccgcggtttttcaaatacaaaaagctttctctgtaagctgcctgcctgtcattataagcgcagggaatctcttgatgctgcgtatattcacaagcgacaatgggaccgtactccagataaggcacagcggtttcccattcattcgcgcgggacgtgacaatcagtccgtcaatctttttcattttcagcagttcgaaataggtcatctctatagcggggtcatagttggtggggagaagggttgtcacgtaatcatgggcaaacgcttccttcgtgataccgtttacaattttgtcaaagcagggatggtcgctgtacggcaaaatcacgccgattgtattggtctttcctcgaatcagatcaatggcggttcgattaggggtataatccagctccttcatcacttgattcacaagacgccttttctcctcagatacgtacgggtgtcggtttaatacgcgtgatacggtagccaccgacacattcgccagtttcgcaatctcttttatatttgccatgtgctcctccatttttggtgataaaaaagcagcaagagtggatttctcttactgctatctcatcataaatccactgtcatttcaacagggcaatggtcagaacccatgatatcggcgcaaatggccgcttcgctgatccgcggcttcagtctgtctgaaacaatgacgtaatcaagccgccagccgatgtttttctcacgtgcgttcgtcctgtaagaccaccaggaataggcgccttcccgatcaggatataaatagcggaatgagtcggtaaatccggtgttcagcagggcgctgaacgcttcccgctcctgatccgagaaaccggcgttcttccggttggctttcggattttttaaatctatctccctgtgtgcgacattcagatcgccgcataatatcacgggcttcttccggtcaagcttctgcagatactccttaaaatcggcttcccattgaagacggtaatcaattcgctctaatccgcgtttggcattcggcgtataacagttgacgacgaacaggttctcaaattcaagtgtgatcacccgtccttcttgatcatgatcgtcaattcccagtccataaaacacgtgaagcggcttttctttcgaaaaaacagccgtgcctgagtagccttttttcaccgcgtagttccaatagtcatgatacccttcaagctgtaatgatacttgtccgtcctgtactttcgtttcttgcagacataaaatatcggctttcgtttcctgaacgtaagtattgatatctatctttttcatcacggcacgtaagccgtttacattccaagaaatcagtttcatgtgttcccccctgtccggctcagccggcattccagtgtttcaatgtttccgccctctaatgccagcagctgctttttcatttctaaaccgcctctgaatccggtcagttttccgttttttccgatgacgcgatggcacggaaccgtaatcaataccggatttttcccgattgcggcgcccacggctcttacggctgccggtttctgaatcatttctgctatatccgaataggagtatgtctcgccgtacggtatgtccataagcgctttccatacagcaagctgaaattctgtcccgtaaagatccaccggcactgaaaaagctgatctgccattttcgatgtactcggacagctctgccgtgtaagacgccagcttctcatcatcacgtgccaatcggtattgcggcagtgatttttttgcccactgctcaagctcttcaaagcttccatgatttgaacctataaagcaaagccctttagatgtggcggctgtatacaggctccaatcattccgtgtgaaaagtgtccaatagaccattgtctctttactcatattgaacctccctgtcccattccggcagtttttcggtattctgtgggcgaattcccggttctctttttaaaaagagtggcaaaatgcgctgtgtttggaattccgaccgtcagagcaatctccatgactgtcatatcagtatgctttaaaaggtgttccgccttcgccaatcttatgttctgtatatactcaatcggggatattcccctgatttttttaaatgtccgctgtaaatgataagggctgccgtgacacatttcggccagtacactcagagtcagagattcgtgataatggcggtcaatgtactcaatgatttgagcaatccattcttcatcaggaagacgaagaccgttcggccggcaccttttacagggacgaaaatgtttatcaagcgctgcatcagccgtatcaaacaccagcacgttttctttattcggagctctcgatttacaagaaggccggcagaaaatccccgtcgtctttactgcataataaaatgccccgtcataagaagcatcattgcgtatgattgcgctccacttttcatcagtcaggatatttctgtctgtctccatctcagccaccccctgttcttcagtataaacaaattcattgcataagtacgcgtatttgaatagaggagcaagataacaaagatagatgtcaggagcacttccatgtttcatgtgaaacatttcggcaggatggaggaggactgatataaaaaaagagcaggagcccgcaggctcttgctcttttctttcggcttactcgccagttacgtatggaagtaaagccatttgacgtgcgcgtttgatcgcgatagtcaatttacgttggtatttcgcgtttgttccagttacacggcgaggtaagattttaccacgctcagaaacaaactttctaagaagatctacatctttgtaatcgatgtgcgtaatgccgttagaagtgaagtaacaaaccttacggcgtttcgcacgaccgcctctgcgtcctcctgccattgtcatttcccacctttctcgttatgaatatagcgataatctattagaacggaagatcatcatccgagatgtcaatcggcttgccgtcgttggcaaatggatcatcattaaaactgttcccttgatttcgtctctggttgttctgatttccgccgaacggattatcattttggcctccgccaaagtattggcctccgccgctgtttccttcgttgtatccgcctgatccagaaccgccgctgtttttaggctcaagaaattgaacactttcagcttggacttctgtcacgaagacacgctgtccttgctgattttcataatttcttgtctggagtcggccgtctacgccggcaaggcttccttttttaagaaagtttgcaacgttttcggcttgtcttctccaagtgacacaattaatgaaatcggcttcacgttctccggactggttcgtgaatgtacgattcacagcaagagtaaacgtggcgacagccgcaccgcttggcgtataacgaagctctgggtcttttgtcagtcttccgactaatacaactcggttaagcatatgaaagaccaccttttaacattatatatttcaaattgcttattcttcttctttaacaacaatgtggcgaatgatatcgtcactgatcttagctaaacggtcgaattcagcaaccgctgcagcttcagactgaacgtttaagatttggtagaaaccgtcacggaaatcgttgatttcgtaagcaagacgacgtttaccccaatcttttgttccagtgatctccgctccgttagaagtcaatacgttgttgaaacgctcgataactgccttctttgactcttcgtcaatgttcggacggataatgtacataacttcgtactttttcatctgtttgcacctccttttggtctaagcggccctataatgggcaaggagcaataattctattactcacaagtttatattataccaaagctcttgtccctttacaactgtgtcctatacattaaatcggaaatgaatgacatctccgtcttggactacatattccttaccttccagacgcacttttccggcttctttcgctccggacattccgccgcctgccaaaaggtcttcataagcaaccgtttcagcgcggataaagccgcgttcaaagtcagtgtggatgatacccgcacactcaggagctttcatgccttttctgaatgtccatgcgcgcacttcctgttcgcccgccgtaaagtatgtcgcaaggccgagaagagagtatgacgctttaatcagctgatcaagacctgattcttcgatgccgagctcctcaaggaacatttgcttttcttcgccttccaattcagcaatttcagactcaattttcgcacagacgacgataacttcggcattttcacccgcggcgtactcacggattttcgcaacgtattcattgtctgaaggatcagccacttcatcttcgcttacattcgccacataaagcacgggttttgacgtaagcaaatgaagctgcttcacaagcttttgctgttcttccgtaaattcaacggaacgggcaggcttttcttgttcgaaagcttcttttaatttagacagaatgtcaaattcaaaaaccgcttctttgtctttttgcttcgcaagcttgcttacacgcgtgatgcgtttttcgactgtctccatgtcggcaagaatcaattcaagattgatcgtttcaatatcgtcaatcggatcgactttccctgacacgtgcgtaatattgtcatcagcgaatgcacgtacaacgtggcagatcgcatcaacctgacggatatgagaaagaaacttatttccgagtccttcacctttagatgcgccttttacaatccccgcgatatcagtgaattcaaacgcagtcggcaccgtttttttcgggttcaccaattcagtcagcttttgcagacgttcatccggcacttccacgattcccacgttcggatcaattgtacagaacgggtagttggctgattcggcaccagcctgggtaattgcattaaataacgtcgattttccgacattcggcaaaccgacaattccagcagttaaagccattctttcatctcctctatatcaaaccatcatcgtataaacgtattgtaaacctagagcaattataaggaggttcataggaaaagacaagctgagaaaaaagcatttcccgccctctctctccttagattatccttttttaaccgctaccagacagtcaaaaagcgtacttcccattccattatcggaatttgaatcctttgtgagcatgttgacggagcctccgaatgccgcccacatgccttcatctatattcaccgtcttcgggtgagccttcttcatgattttcaccctgccgcgcagacggccgcggtcattgtatacctctgccgtatctccgtcttgaagtgaaagctcctcggcgatatccggcgacaggtccacctgaatctgctggagcttttcaataaacggcacgtgctgtgaatgattggagcgctgcgggtgaatggacagcagcgtatacggatatttcccggccagtccggcgtcgtgataaacagactcctccggcacttccaattgagggaggccgctgtatcctttctcttctgccagtgacgagacgaattcaaattttccgctcggggttaaaaattgaaaatcactccacggaacctgttcgaccggaagcggcatatgtcctttttcctttaattgctcaagggtgattcggattccttctttctccaaagaagagagccccatttttaagaaatcttccgcactgtaatcaaacagctccccgaatccgagacgctttgcgagttccgtccagatccagcggtctgattttgcctctccctgcggttccgcaagcttcttaccatattgaacatagtgatgatacatgctggaataataaatatcttcctcttcgaaaacaacggccgtcggcagcacatagtcacagagcttcgccgtatcggtcatgaccgaatcaatggccactgtgaccggcgttttttcaaacgcttccttcactttttttgtattcggcacctgtgtcagcggattgccgcacgtcacgatgatcatctcaatcggcgggtcggctgcattcagcgcctcttcagcttgagtcatcatcgaaaacgttctcgaacttttcttcaaatcaggacgagtgagctcggcctttgcaaagctttcaccgacttgcacatttccgaagttggcgccgccgcctttgataccgacatttccgctcgccgcagctaaagcgtcaatccaccgtatcgtcccgcccccgtttttatatctctgcatcccaagacccataaaagtggaggcgggaccgtcagcatataaatcggcaagatattcaagcgcttctaaagacgtttctgttttctcaataatctcctcaaaagaaatcgtctgcagaagcttgtctatttcctcaaaaccgaccgaatgcttttgaataaaatcagaatcggttctgccggtttggcataatatttttaaaacacccgccgcaagccagccatccatgccgggtttgacggatatataccggtcggcaagctttgcagtcgggttaaaaatagggtcaatgaccgtcagtgtcgctccttttttcttcacctgctgcagatgatgatagaggtgcatattcgtccgggacacgtttctgccccatacgatcacatgcttgctgtgataaatatcaagcggtccatgcccgtaagaacgcccgaaatcccagcgctgcgcttcaatgccggaaccccagcaaatgctgcccgcaatctcggttacaccgccgtatccattgaaaaaacgctggtcgagcgccttcaaaagaccgttattggcgtagtcatgactgtgcagcactgcggcagtgcccaacgtctccttaatcaccgccattttttcagcaatttcatctaacgcctgctcccaggaaatgcggacaaattcgccgtctttcttttttaaaggaaaacgaagccgttccggcgcattcgttttcgtctccagcattctgccccggccgcaaattttcccttccgtaatgggatgattcgggtctccgtctactttcgtcacctttccatcctcaactgtcaccaaaaagccgcagctgtcccagcaattcagcgggcacgctgactgatgcactttgctcatcgggcctcttcctctcctctatatgaaaaagcatgagcgccagcccttatgatgtaggctcctcatgcttgacgagtacttttttcagctttctctcaaaatctcttctcggaatcatgacactgtgggaacaacccgtgcatttgatccgaatatccattcccatccgaatgattttccacctgttttcaccgcaaggatgcggcttcttcatttcaacaatatcattcaggccaaagtctttatccgccaagacccttcacctctctccatagactgctttatttattgtacaaaaaaagacaggataagagcaacggccgcactcaaaatgagcattatacttttttccatctccctaaaatagggtaaagaagaagacataccagcaaataaagacttaaaagcccgtaaatgggatataaaatggcgatcaaatctgaaaaaccgattgtcgtaaaaggcaccatcacagctaaaagaagagatacgagcatccatctcggcaatttcacaaatgcaagcatgcggctggacagcccgaaaagaccggtcaccgttgtcgtatagatggctaaaaaaagcacggcggccatacaaagaaataacggataaggagcgccttcaaggacggcgaaaagaggaatctcatattgtgtaagactgcctgaaagctgtacaagcgtttcattgtaaacaaatgaaatcataccgaaaatcagcccgcttgcaacgcttgcgattttggcttctcccagtcccttcatatctttcccgattgaagaaagaacagcgacaacagaaagaatgtttaaggacgtgaaggtaatgcttgccggccaattatactggcgggtcaagtctatcgtccacgtgtaatgatgcgttgtctgaaaaaagaccaatgcatataacagccccgctacaagaatcggtatcaaaatactattcagagataatatcccttttatatcccaaaagaataaacccacggtcacaatgcaaagaagaaaaataccgatccaaaacggcagcttgtacatttgcagcgtcacaccgccgccggcaatcataaccatcgtcattgaaaacaaataaaacataataagcacatcatagactttagcaagagccggccccatcagatgctcaagcacaggtaaaaagtgcgttgattgaacccgatagctgatcttcaacacaatataagccgaaatcgtaaacatgactgtaaacaatacaatagccagtccgctttcgacaccgaaaaactgccatatttcctgcccgcttgcatacccggccccaatctggctgcttaatatgagcagcatccacttcatcccggctctccacaccctcatcacctcataaaatttctgatcatctccgcatattgctactatattgagtgacagcagcaaacattcatacaaatgggacaaatatggtatgataacgacgattgactattcagaaaatttatttatgttaggcgctcaaatcatggacatcaggcgtttaaccgcaagtgatacccagccttactccgattcaggctcaaagctttaaaagatcacccggacgcaatcgccgtcagctatgaggccgtccgaaaaattcaaagccaggcttgaagccggcaatgccatcttgcttggcgcctttgaacaagacagcctgataggaatcctcaagatctccaagcatctgctgtttaaactaagacacattgcggttatcggttctatgtatatttcccccaaacacctagggtcaggcgcgggaaaagctttaatgacggaagccatcagccgggcaaaaaagatgaaagacacagaacagctccatctctctgttacttcaacaaatggaacccgcaaaaaaactctgcgctcagttaggattatcctcttctctgcagaaaaaagagcgctgaaattggatcatcagcaatatgtcgacgtagatcaaatggtcttatttctttcatgaacttagagaataactgctctgagttcttttttctatccgctcttttcaaacaaccggcatgctcatcatgacataagcataaaaaaaggcagcgctggatatactgtaaacaaccatacatcaccaaaaacaacaatgtaatactcgtatgacatgacaaggaagtgaaccttatgaatcgaaaaggcgggcttttttctcaagaacgggcaaaacaatatgtttctcatacggattcttctgctgcgaatcaaatacaagcaatccttacttcatctttacgtaaagcagccggcagaccgttagtcaccgtatgtatcggtacagatcggtcgaccggagattcattaggtccgctcgtaggaacaaagttagaaaaaatgaatttaggcagattgcacgtttacggcacgctgtcagatcctgttcacgccgtcaatatgaaagacaagctgaaagatattcaacatctacataaaaatccgtttattatagcggttgatgcttgtttaggccgcgtcaaaagcgtaggctcatttcaaatcggcgatgggccgctgaagcccggagcaggtgttcaaaaagaccttcctgaaatcggtgacgtccatatcaatggaatcgtcaatgtcagcgggtttatggagtattttgtcctgcagaatacgaggcttcatcttgttatgagcatggcaaatgttttagcagaggggttacagctgacagataaatcagaaggccggcaggaacggctcagtccgtttcataagctgacaagacgtatataaaaaaccatcttttttaaaaaagatggtttttacgcttctctttcggacaatagttccaggatacgttcaagatcttcatttgagaaaaactcaatctcaatcttcccttttttcttttgtctcttaatattgactgttgttccgaagtaattttgcaaatacgattcccgctcttttaacacaacatcttggacaggttcttttttctttgtttcacgtggaacattgttgtttaactgctgaatcagctgctcaagctggcggacgttcagctgttcttcaaccactttcttcacaagcggttcaagcttgtttttatttttcaagccaagcaaggttctgccgtgtcccatggataacgtaccttctgcaatgaggttctggatgctttccggcagcgtcagcagtcttaaatggttggcaatatgaggcctgcttttcccgagccgtttagcgagctgttcctgggttaaatccaaatgcttcagcagtgagtcatatgccagagcttcttcaagcggtgataagtcttcacgctgaaggttttccaaaagagcgatttcccgcatcagcgattcagataaatcccgcacgatagccggcactgtctctttaccggcaagttttgcggcgcggtaacggcgttcgccggctacaatatcatagcccttcaatgattttctcacgataatgggctgaagaatgccatgctgaatgatggattccttcagttcagctaatgactcatcatcaaattgttttcttggctgataaggattggggcgtaaatcactgattttaatttcttccactgtctcttcagacaaatcaacctgattaaacaacgcgttaatcccttttccgagcccgcctttagccattcgctgccacttcctttgctaaatctaaatatacttccgcacctctcgaacgcggatcgtataatatgatcggcttgccgtgactcggcgcctcacttaaacggacattgcgaggaataatggtttgatacactttatctctaaagtatttctttacctcttctatcacttgaatgccgagattcgttctggcatcaagcatcgtcagaagcactccttctatcattaagtcggtatttaaatgtttttgcacaagccgaactgtatttaataattgactcaatccttcaagagcgtagtattcgcactgaaccgggataacgactgaatctgaagcggtaagcgcattaatcgttaataacccgagagacggaggacaatcaataatcatgtaatcgtaattttgtttcacagattctaatgctcttttcagcctgacctcccgtgagatcgtcggaaccaattcaatttccgctcccgcaagctggatcgtggccggaatgacatctaagttctctactgaagtcggtttaataatttctgtaacatctgcatcatctactaaaatgtcgtacacacaatgatccacatcggctttttcaatccctaatccgctcgttgcattgccctgcggatcaatatcaacaagaagaacccttttacctatgtaagccaagcaagcccccagattaacagaagtcgtcgtcttcccgactccgcctttttggttcgtaattgctatgatttttcccacgatgtcacctaccttcacatgaacatgtactgtcttgtttctatcttatcaaaaaaagagtaaagcgttttatttttttcataatttgtttatcagcaagtgaaaaaaatgtaaacgaaaaagacactttctaatataagttctccgataaagtgacttttttgactgtaaaaagacaattcacgacacaaaaagataaaattttacatatgtaatgtatagtgcacaataaatctattattatctcaaaatagttttttgattaaaataaaaactcccctgctgatcaggagagtttttatttaggtatccgaatggtaagctggatgtactcttcgaattcttcttcttcagtgttcagcctgacgccgctgtcttccaccatggacagtgactgacgaatcgtattcatcgcaattcttgtatccctgctgaacgctttgcgtctcggctttggtttctgcttattctgttcaagcattttcaccactctgtcttccgtctgcttgacgtttaagcttttctcaatgatttccgcaagcaatgtgacctgaaactccggctgtttgagcggaatcagtgctcttgcatgacgttccgtaatttttttctccataatcgcatcctggacgggttccgggagctttaacaatcggagcttgttcgcaatcgttgactggccttttcctaagcgctgcgccaaggcttcctgtgttaaatcatgaagttctaacagccttgcgtacgcatgagcttcctcaatggaggacaattcttccctttgcaggttttcaatcaaagcgacagatgctgtttccgtatcagaaaaatctttaataattgcgggaatattctcccattcaagcgtctgtaccgctctccagcgcctttcacccgcaatgagctcatattgtccttcatcttctgtatgtctgacaacaatcggctgaatgatgccgtgtgtatggatagtcattgctaactctttgattttttcatctgagaaaatggtgcgtggctgaaaacggttgggaacgatagcatgtaccggtatttcgagtatctcttctttgtttgtatcatgctcagctatctccggttcctcttccttctcaccaaacccgaagaaacgagagaatgaatgcttcatgtacctacaccacctttaaaaactgccatttttataattctattttctcatggtttttcctgctgtatcttcatcaattttgcagaaaatatgatggaattgtcacatcaggctgtctaaattacccttcaattggcgatttatttggagtacccggttttctcggatattttttcggagtgcttttcgtcttgcgaatgatcataatgttccgttcactttcttcaacgggaagtgtaaaggaatgaacttgttcaagctctcctcccaatactttaatcgccttttgccccgctttcagctcttcatcagcggctgcagcttttagtgccgcaaatataccgtttttcttggccagcggcagacaaagctcactcaggactgacagacgcgccactgcacgggccgtcacgagatcgaagctttcccgtacgtctttccgctgtccgaatgtctccgctctgtcatggacaaatgtcgtatgctctaattgtaaagcatcagagagagtttccaaaaacgtaatccgcttattcagtgaatcgacgatggtgacatgcagatgcgggaagcagattttgacgggcaggcttggaaaaccggcgccggcgccgacgtcacaaagagtggtgaccttttcaaaatcaatataaaatgccgccgttatcgaatcataaaaatgcttgagataaacttcctttttctcagtgatggatgtcagattcattttttcgttccattccacaagcatccggtaatacaactcgaattgctccagctggcggtcagaaagggaaatccctttctccgctaaactggatgtaaattgctctatattcatgccgtcatcctttctattcagctaccttggcaatacggccctgctccaggtataccagcaggattgaaatgtctgccggattgacgccggaaatacgggacgcttgagcaactgataaaggacgcacttctttcagcttttgacgcgcttcagtagcaattcctttaatggcgtcataatcaatccgatcagggatttttttgttttccattttcttcagcttttccacttgctgcaaggatttttcgatatatccttcatatttcacctgaatttccacttgttccgccacatcttgcggaaccggagaatctgcaggcgcaagttttgtcactgtttcatagttcatttccggacgtttcattaaatctgtgccgcgcactccgtctttcagctcgcttccgccgagtgaacggatatattcctgattctcaggagacggcttgataataacagaccagagacgttttttctctgcctcgatcgccgcttttttcttctcaaacgcttcatagcgctcatcagaaattaagccgatctcatggccgatttccgtcaggcgaagatccgcgttgtcgtgacggagcagcagtctgtattccgcccgtgaagtcagcagacgatacggttcattggttcctttcgttaccaaatcatcaatcaatacaccgatataagcatcggaacggctgaggatcacttcttcttttccaagcgctttgcggcctgcgttgatccctgccataattccttgcccggctgcttcctcataacctgatgtaccgttaatttgaccggctgtgtacaggttagggatttttttcgtctccagtgtaggccagagctgcgtcggtacaatcgcgtcatactcaatcgcgtatccggctctcatcatctgcaccttttccagtcccggaatggtcgccagcatccgctgctgcacgtcctcaggaagactcgtggatagaccctgaacgtatacttcctgcgtatttctgccttccggctcaaggaaaatctgatggcgcggtttatcattaaaccgaacgactttatcttcaatcgaagggcagtatctcggtcccgttcctttaatcataccggaatacatcggcgaacgatgcaggttgctgtcgatgatctcatgagtctcaggactcgtgtaagtcagccagcaaggcagctgatcggtaatgtattcaaccgtttcatatgagaaagcgcgcggaaccgggtcccccggctggatttctgttttgctgtaatcaatggaatcgcttgagacacgaggaggcgtgcccgttttaaaacggacgagatcaaaaccgagctcctctaagtgctcagaaagtttaatagacggctgctggttattcggaccgcttgagtaagacagatccccgagaatgatccgccctcttaaatacgttccggttgtcagcacgaccgtttttgccttgtattcagcaccggtttgcgtaatgacaccgcggcactctccgtcttcaatgattaaacgctcggcaatcccttgaagaagtgtcaaattcggtgttttttccagcgtatgcttcatttcgtgctgatattggaatttatccgcctgcgcacgcagcgcccgtacggccggaccttttcctgtattcagcattctcatttgaatatgagttttatctatatttctagccatttctccgccgagcgcgtcaatttcgcggacgacaatccctttcgcggggccgccgacagacggattacatggcataaacgcaaccatatcaagattaatcgtcaaaacaagcgttttggctccctggcgcgcggatgcgagggcagcctcaacaccggcatgcccggcgccgatgacaatcacgtcgtattggcctgcttcataccccatggttttttcctcccttttatttacctaaacaaaattgtgaaaagagctgatcaattaagctttcgtggacggcatcaccgatgatttcgcccagcagttcccagcaccttgtcaaatcaatttgcaccatatcaatcggaacatcctgttcaatcccgttcagcgcatcatcaatcgcttgctttgcctgatgcagaatcgaaatatgacgggtgttgctgacataggtgagatctccgctttcgatcgctcctgtataaaatagcgactgaatcgcttcctctaaatcttgaatgccttcttctttcagcaatgaggtcgtgacgacaggccggcctttcgccagttccttgacgcgctcagcgtcaatcttagcctcaaggtccgtcttattcataatgacaatgacgtccattccctcaaccgcttcaaacaatttcacatcttcttcagaaagcgcttcgctgtggttaagcacaagcaaaatgagatccgcttccttcagaacctgccgtgaccgttccacaccgattctttcgacgatgtcttctgtctcacggattccggcggtatcgacaagccgaagcggcacgcctcgcacgttgacatattcctcaatcacatcacgcgtcgttcccggaatatcggttacgatcgccttcgtttcatggacaaggctgttaagcagagaggatttcccgacgttcggacggccgatgatcacggtagacagtccctcacgcaaaattttcccctgctcagacgtacggagcagcgcctcgatttctttcttcacgccgcttgccttctccactaaaagctgatgcgtcatttcttcgacgtcatcatattccggataatctatattcacctcaacatgggcaagtgtttctaacaactcatcacgcagacggcggacaagcgcggaaagccgtccttccatctggttcatggcgacattcatggcacggtccgttttggccctgatcagatccatcaccgcttccgcctgtgaaaggtcaatccgtccgtttaaaaatgcgcgcttcgtaaactcaccgggttctgccagtctcgcaccttctcttaaagcaagctggagcacctgattaaccgtcacaatacccccgtgacagttgatttcaatgacatcttcccttgtgaatgttctgggcgctcttaaaacagacaccatgacttcctcaataatccgtcccgtcgtactgtccgcgatatgcccgtaatgaatggtatgcgattctgccgaactgagcgttttgcctttcggacccttgtacattttgtcggcgatctttacggcttccgggccgctcagccgaacgatcgcaatcgcgccttcacccatcggagttgaaatcgccgcaattgtatccatgctgttcacctctctttatctctgtttccatctatataaaaaatttatttatgccaaaattaaaagataacatagtttggtttgaagtggaagatacgttatccacaaaagcagaaattcatcccttattactttaacttatccacatgtgaataacaattaattttatttcctaaaaccttttttatcaacagcatagaccgaaaaagaaaaaacttaaacgcaaaaaatgcgattctgctcaggaatagagccatttttaccaataaaaaaaccgaagttccgattttacccggacttcggttttctgctatctttatgggaaataacgagatggcggtaccggccttcaccggtagaaaacgttttgatatttggatgctttgacagcgcgtcatggatgatttttctttcacctgacggcatcggttctaaatgcacctcttttttcgttttcgacacttgcttggccagcctgtttgccagctgatccagaatttctcttcttttccgccgataattctcagcgtcgacaacggcttggcgatactggccggagccgcggttcaaaacaagctgcgtcaatgtttccaaggcattgagtgtttgtcctcttttgccaataagcagcgccgctttttcacctttaatgtgaaaacagactgttttcttgttttcttccgtaacaatctcagaaggcccggcaatggaatggatgatttcttctaaatacgctttcgcttcctgaacaggatttcttttctcttccagttctacgatcgcattcttttttccgaaaatacccaaaaaccctttatattcttcttgcaccaccgttatttctacttgatctttcgtcagttgaagttcctgaaggcctgattgaactgcttcttcgacattccgtcccgcagcagtcaccttcttcactttttctttcctccggctttctgcgtttccggatcgtgtttaatgtcaggtcctttaataaggaatgtctgagcaatcataaacaggtttccgactacccaatacagagaaagcgcgctcgggaagttgatcgcaaatacgatgatcatgatcggcataatccataccatcattgccatttgaggattctgagtcggatttcccgccatcatcagcttctgctggacaaaagtggccacaccggcaacgataggaagaatatagtaaggatccttctctcctaaatcaaaccataaaaagctgtgctgtgaaatggcttgcgtacgcataatcgcgtggtagaatccgatcaaaatcggcatttgaatcaggatcgggaaacatcccgccagcgggtttaccccgtgctttgaaaacagggccattgtttcctgctgaagcttctgctgcgttttttgatctttagagctgtatttttctctgagcttctgcatttcaggctgcagcgcctgcatcgcttttgagcttcgaagctgcttgatcatcagcggcagaatcagcagacgaattaaaatcgtaacgatgatgatcgacaaaccatagttatcgcccgtcagtttcgctacgtacgtaatgacttctgacaatggatacacaacatatttgtcccagaaatgcggactattcgccgtaatcggctctttcacactcgagcacccggccagcagcacgagcataccgaccatactcagtagtaaccatattctccttttcaagaacgtttcctcctataccaatctttataaaccttgtatgtattttagcatctttcagtttcaaatggcgttcatttttcgccaaataaaaggaagcgcttttaaaaacgtgaagaaaacaaaatatgagctattttgacgaagatttcttatataatgaggtttttctgaataagtgctgcagactctttttcgtttcttcaaaactgaggtcgccggcgggttttcttgcgataataataaaatctttcggcttgagcagctctttttcctcctgaaccgcctgcctgattaaccgcttcacccgattgcgcacgacggcattgccgatttttttactgacagaaagccctacccggagctcttcctgtttcggctgatcaagcgtatacagcacgaactggcggtttgccatagacgttccgcgtttaaacactttttgaaaatcttcatttttctttaaccgatttcgcttcttcactttaattcactccgatattcactcgcagaaacttttatttctatttaaaaaaaacgggccgccggaatactgaagaaatttctccagtaccgggcgacgcatgacatctcttttctcttaatgtgaaaaaagaccactgacattattcagtggcctaagctgataatacttttctgcctttgcggcgacggcgtgctaatactagacgaccgttttttgaactcatacggcttctgaagccatgaactttactgcgtttacggttattcggttggaatgttcttttcatttatgacacctccctcgaggaatagctgttaaagacagtcttacttattatatttgtgctgcctattcattgtcaacttcagcagtgcttttatttcttacaaccataataggataacataccttaaccagattagaaaccttatttttcatattcctttttttaacgcacaaaaaagccgcgctcccccgaaaaaacgacatgtggataattttttggtctttttttaatatccacaatcgttatcgacaacattttcacattgctaacccctgtggacaaagatttttcaacaagttgtcaggtttgtggataagattacgagaaccattgcaagtcctcgcttaatttgatattatatttgtgttttaactcttaattacttatccagtccattctctttatccacaaattgtggataagttgtggattgttttcacacagcttgtgtagattgttgtccacaacttgtggaatttgtcgaaaagctatttttctactatactatatgttttcaacatttcgtgtgtacgaatggtcagagccatatgctctttttttgtgttctataacaggggaagggcgctgatttttaaagaaaaggagggctgtgccggataatggagaatatattggatctttggaatcaagctctagctcaaattgagaaaaagctaagcaaaccgagtttcgaaacttggatgaagtcgacgaaagcccattcgctgcaaggagataccttaaccatcaccgctcccaatgaatttgccagagactggctggagtccaggtacttacatctcattgcagataccatatatgaattaaccggggaagaattgagcgtcaaatttgtcattcctcaaaatcaggacgaagaagactttttgccgaaaccgcaagtgaaaaaagcggcaaaagaggaaccgtctgattttccccaaagcatgctcaacccgaaatatacattcgacacattcgtcatcggatcgggaaaccgattcgcccatgcagcatcactggctgtggcggaagcacccgctaaagcgtacaaccctttatttatatacgggggagtcggtttaggaaaaacccacttaatgcacgcgatcggccattatgtcattgatcataatccttcagccaaagtggtgtacctgtcttctgaaaaattcacaaatgaattcatcaactcaatccgcgataataaagccgttgatttccgcaaccgctaccggaacgttgatgtacttttgatagatgatattcaatttttagccggaaaagaacaaacacaggaagagtttttccatacattcaacacgcttcatgaagaaagcaaacaaatcgtgatttccagtgacagaccgccgaaagagatcccgacccttgaagaccgcctgcgttcgcggttcgaatggggattgattacagatatcacaccgccggatctggaaacgcggattgccattctgagaaagaaagcgaaggcggagggccttgatattccgaacgaggtcatgctttacatcgccaatcagattgacagcaacatccgcgaactggaaggggcattgatccgggttgtcgcctattcatccttaatcaataaagacattaacgcagacctggctgcagaagcattgaaagatattattccgtcttctaagccgaaggtcattacgataaaagagattcagcggattgtcggacagcagttcaacattaagcttgaagatttcaaagcgaaaaagcgtacgaaatcagtggctttcccaagacaaattgcgatgtatctttcaagagaaatgacggattcttctttgcctaaaatcggggaagaatttggcgggagagaccatacaaccgtcattcacgcccacgaaaagatttcaaaactgctgattgatgacgagcagcttcagcagcaggtgaaagaaataaaagaactgcttaaataatagtgtcctcggatgaatcggggaaagtgtgaataactttttcatagccatacacagtctgtccacatgtggataggctgtgtttcctgtctttttcacaacttatccacaaatccacaggccctactattactactgctatttttaaaatatattaattatattatccgttaggaggataaacatgaaatttaggattcaaaaagatcggttagtcgaaagtgtacaagacgttctaaaagccgtttcatccagaaccacaattcccattctcaccggtattaagatcgtcgcctcagatgaaggagtatctttcacaggaagtgactctgatatttcaattgagtcattcattccgaaagaagatgatgataaagaaatcgtgacgatcgatcagccgggaagtatcgtgctgcaagcgcgtttcttcagcgaaatcgttaaaaaactgccgatggcgactgttgaaatcgaagttcaaaatcaatatttaacgattatccgttccggaaaagccgaatttaatttaaacggccttgatgcagatgaatatccgcatctaccgcaaatcgaagagcatcacgccattcagattccgacggatcttttgaaaaacctgatccgccaaaccgtgttcgctgtgtccgcctcagaaacacgccctatcttgacaggtgtaaactggaaagttgaaaacagtgaattattatgcactgccacggatagccaccgactcgctttaagaaaggcgaagcttgatattccggaagacagctcttataacgtggtcattcccgggaaaagcttaaccgagctgagcaaaattcttgatgacagccaagagctggtggatatcgtcattacagaaacccaagttctgttcaaagcgaaaaacgtattgttcttctcaagattgcttgacggaaactatccggacacgaccagcttaattccgcaggaaagcaaaacggaaatcgtcgtgaacacgaaggaatttttacaggcgatagaccgtgcttctttattggcgagagaaggccgcaacaacgttgtaaaactttctgccaaaccgacggattcgcttgagatttcatcaaattctccggaaatcgggaaagtggtcgaagctgtgctggcagacaagattgacggcgaggaattaaatatttcattcagtccaaaatatatgatggacgcactgaaagtacttgaaggagcggacatccgtatcagctttacgggagcgatgagaccgtttcttatccgtacgccgaatgatgagaccatcgttcagctcatccttccggtcagaacgtattaatcaaacagaatgtgctgccggcttagttcggcagcttttctattcatcagccgctccctcaagttttccctttccttatttcaggattttttagtacaattagatattagtgatatttgaaagaggtcgatattatggcaaatccgatttcgattgatacagaaatgattacgcttggccagtttttaaaattagccgatgtgattcagtccggcggcatggcgaagtggtttctgagcgagcatgaggtgactgtcaacaatgaacctgacaatcgccgcggcagaaagctttacgttggagacgtggtcgcgattgaaggatttggttcatttcaagtcgtcaattaaagcgggtgacagcggttgtatatccaaaatttagaattaacatcctaccgtaattatgagcgcgctgagcttcaattcgaaaacaaggtgaatgtgatcatcggggaaaatgcccagggcaaaaccaatctgatggaagccatctatgtcctttcgatggcaaaatcacaccgcacctcaaatgacaaagaacttatacggtgggacgaagactatgctaaaatagaaggaagagtgatgaagcgcaacggggacatcccgatgcagcttgtcatctccaaaaaaggtaaaaagggcaaggtcaatcatatagagcagcaaaaactcagtcagtatgtcggagcgctgaacaccattatgtttgcccctgaggatttaaatctcgtcaaaggaagccctcaggtgaggagaagatttctcgatatggagatcggtcaggtttctgccgtttatctgtatgatttatctctttatcaaaaaatcctttcacagcggaatcattttctgaaacagctccaaagccggaaacagactgaccggaccatgcttgacgttctcactgatcagctgatcgaagcagccgcaaaagttgtcgccagacgtctgcagtttacggcgcagcttgaaaaatgggcgcagccgatccattccggcatttcccggggaattgaagaactgacgcttaagtatcacacggcgcttgatgtatcagatcccaaagatttgtcgaaaataggtaacagctaccaggagtctttttcgaaattaaaagaaaaagaaatagaacgaggcgtcacattattcggaccgcatcgggatgatgtccttttttatgtgaacggacgcgatgtgcagacttacggttcgcagggacagcagcgtacgacggctttgtctctgaagctggctgaaatagatttgattcatgaagaaatcggagaataccccattttacttttggatgatgtactaagcgagctggatgattaccgacagtcccatttgcttcatacgatccaaggccgtgtgcagacatttgtcaccacgacgagcgtggatggcattgaccacgataccttacatcaagcaggaatgttccgtgtggaaaacggtgcgttagtgaagtgaagaaatgaggtgagcgattgtatattcatttaggtgacgactttgtcgtttcaacccgcgatatcgtcggcatttttgactgcaaggtcaatgtatcgccgatcgttgaagaatttctggacagacagaaagaaaaagtagtgccgtccgtaaacggcacgccaaagtctatcgtagtcacgactgagaatatatattactctcccttatcttccggcacactgaagaaacgtgcgcaatttatgttagaaatagattcttagcggatctttacaatgaatatattatcgtttaagaaaagtgtaggtgaatgtgcatggctatggaacagcagcaaaatagttatgatgagaatcagatacaggtattagaaggtttggaagctgttcgaaagagaccggggatgtacatcggatcaactaacagcaaaggccttcaccatttggtgtgggaaatcgtcgacaacagtattgacgaagccctggccggttattgtacagatattaacatcgagattgaaaaagataacagcattaccgttaaggacaacgggcgcggaattccggtcggtatccaggagaagatgggccgccctgcggttgaagtcatcatgaccgttctccacgccggcggtaaatttgatggaagcggatataaagtatccggcggtcttcacggtgtaggggcatccgtcgtaaatgccttgtcgaccactcttgacgttacggttcatcgtgacggaaaaatccattatcaggcgtacgagcgcggtgtacctgtggctgatcttgaagtgatcggcgaaactgataagaccggaacgattacgcacttcgttccggacccggaaattttcaaagaaacaactgtatatgactatgatctgctttcaaaccgtgtccgggaattggccttcctgacaaaaggcgtaaacatcacgattgaagacaaacgtgaaggacaagaacggaaaaacgagtaccactacgaaggcggaatcaaaagctatgttgagtacttaaaccgttccaaagaagtcgttcatgaagagccgatttatatcgaaggcgagaaagacggcataacggttgaagttgcattgcaatacaacgacagctatacaagcaatatttattctttcacaaataatatcaacacatacgaaggcggcacgcacgaggccggatttaaaaccggtctgacccgtgtcataaacgactatgcaagaagaaaagggattttcaaagaaaatgatccgaatttaagcggggatgatgtgagagaagggctgactgccattatttcaattaagcaccctgatccgcaattcgaagggcagacgaaaaccaagctcggcaactccgaagcgagaacgatcactgatacgctgttttcttctgcgctggaaacattccttcttgaaaatccggactcagcccgcaaaatcgttgaaaaaggtttaatggccgcaagagcgcggatggcggcgaaaaaagcccgggaattgacccggcgcaaaagtgcgcttgagatttccaatctgccgggcaaactggcggactgttcttctaaagatccgagcatttccgagctgtatatcgtagagggtgactctgcgggcggatcagcgaaacagggacgggaccgtcatttccaagccattctgccgctgcgcggtaagattctgaacgttgagaaagccagacttgataagattctctcaaacaatgaggtcagatcaatgatcacggccctcggaacaggaatcggagaagattttaatcttgaaaaagcgcgttatcataaagtggtcatcatgacggatgccgatgttgacggcgcccatatcagaacgcttttattaacgttcttctacagatacatgcgggaaatcatcgaaaacggctatgtctacattgcccagccgccgctttataaagtgcagcagggaaaacgggtggaatacgcttataacgataagcagcttgatgagctgttaaaagagcttccgcaatcacctaagcccggcctccagcgttataaaggtcttggagaaatgaacgcgactcagctttgggaaacgacaatggaccctgcgaccagaacgcttctgcaagtcaatcttgaagatgcaatggacgctgacgagacttttgaaatgctgatgggtgacaaagtagaaccgcggagaaacttcatagaagcaaacgccagatacgtgaaaaatcttgatatttaaccaagaaagccttattttcgttaagaaataaggcttttttctcaaagcggcttctaaagcctctgaaaacccgcaaaacccgtatattctactaaattaatgtgtataaacacaagtttattgatataatggagaatagtgaaatcgtattgaagatcataatggacaatctactcccacattatttcatgtgatacttcagggaggtttttttaatgagtgaacaaaacacaccacaagtacgtgaagtcaatatcagtcaggaaatgcggacatccttcctggactatgcaatgagcgttatcgtatcccgggcgcttccggatgtgcgtgacggtctgaagccggttcacagacggattttgtacgcaatgaatgatttaggcatgaccagtgacaaaccatataaaaaatctgcccgtatcgtcggtgaagttatcggtaagtaccacccgcacggtgactcagcggtttacgaatcaatggtcagaatggcgcaggattttaactaccgctacatgcttgttgacggacacggcaacttcggttcggttgacggcgactcagcggccgcgatgcgttacacagaagcgagaatgtcaaaaatcgcaatggaaattctgcgtgacattacgaaagacacgattgactatcaagataactatgacggttcagaaagagagcctgccgtcatgccttcgagatttccgaatctgctcgtaaacggggctgccggtattgcggtcggaatggcgacaaacattcccccgcatcagcttggggaagtcattgaaggcgtgcttgccgtaagtgagaatcctgagattacaaaccaggagctgatggaatacatcccgggcccggattttccgactgcaggtcagattttgggccggagcggcatccgcaaggcatatgaatccggacggggatcaatcacgatccgggctaaggctgaaatcgaagagacttcatcgggaaaagaaagaattattgtcacggaacttccttatcaggtgaacaaagcgagattaattgaaaaaatcgcggatcttgtccgggacaaaaaaatcgaaggaattaccgatctgcgagacgaatccgaccgtaacggaatgagaatcgtcattgagatccgccgtgacgccaatgctcacgtcattttgaataacctgtacaaacaaacggccctgcagacgtctttcggaatcaacctgctggcgctcgttgacggacagccgaaggtactaagcctgaaacaatgtctggagcattatcttgatcaccaaaaggttgtgatccggcgcagaacggcttacgaactccgcaaagcggaagcgagagctcacattctggaaggtttaagaattgctctcgatcatttagatgccgttatttctcttatccgcaattcccagacggctgaaattgcgagaacgggtttgatcgaacaattctcactgactgaaaaacaagcgcaagccattctggatatgcgccttcagcgattaaccggtctggagcgcgaaaagattgaagaggaatatcaatcacttgttgcgcttatcgctgagctgaaagatattttagccaatgaagaaagagttcttgagatcatccgtgaagaacttaatgaaatcaaagagcgtttcaatgatgagagacgcactgaaatcgtgacgtccggtcttgaaacaattgaagatgaagatcttatcgagagagaaaatatcgtcatcacactgacccataacggctatgttaaacgtctcccggcgtccacataccgcagccaaaaacggggcggaaaaggcgtacagggaatgggaacgaatgaagatgactttgtggaacacttaatttccacatcaacgcacgatacgattctgttcttctctaataaagggaaggtataccgttctaaaggatatgaaatccctgaatacggccgtacggcaaaaggcattccgattattaaccttctggaagttgaaaaaggcgaatggattaatgccattattccggtcagcacgtttgatgaggagcaatacctcttctttacgaccaaacaaggggtgtcgaaacgtacggcactgtcccagtttgcgaatatacggaataacggtctgatcgccctaggtctccgggaagacgatgaactgatggccgtccgcctgactgacggcaagaaacaaatcatcatcggaacgaagaacggtttgctgatccgtttccctgaagaagatgtaagacaaatgggacgcacagctgcgggtgttaaaggtatcacgctgacagacgatgatgtcgttgtaggcatggagattcttgaagaagactcccatgtcctcatagtgacagaaaacggctacggcaaacgcacaccggcttcagaatacagagttcaaagccggggcggaaaaggccttaaaacatgtaaaatcactgacagcaacggtccgttagtaactgtgaaagcaacaaaaggcgaagaggacttaatgattattacggcaagcggcgtgttaatcagaatggatattaatgatatctccactacgggacgcgtaacacaaggcgtccgtctgatccgcatgtctgatcaagagcatgtagccactgtggcgcttgtcgaaaagaatgaagaagagccggaagaaacggaagaagtataaacgaaaaagcgcagctgcaacaggctgcgcttttactatataaagaaatgaaaaaaagctttgacacatggtgatgatgctgatataattctttttgttgtctttttaatagaaaggcaagcctagcgaaaatattttttaaaaaagtattgacctagcaaactgaaaatgttatgattaagaggtcgcttcgagaggggcggaaaagttctttgaaaactaaacaagacaaaacgtacctgttaattcaaagttttaaataaatcgcaatttaatattgttttggcggttgtggcgaagtggttaacgcaccagattgtggctctggcactcgtgggttcgattcccatcaatcgccccaaacaacatgcgggtgtagtttagtggtaaaacctcagccttccaagctgatgtcgtgggttcgattcccatcacccgctccatttttatattgtcatgggcctgtagctcagctggttagagcgcacgcctgataagcgtgaggtcggtggttcgagtccactcaggcccaccatgatgatttttccacagtagctcagtggtagagctatcggctgttaaccgatcggtcgcaggttcgaatcctgcctgtggagccatacggagaagtactcaagtggctgaagaggcgcccctgctaagggtgtaggtcgtgtaagcggcgcgagggttcaaatccctccttctccgccataaggcccgttggtcaagcggttaagacaccgccctttcacggcggtaacacgggttcgaatcccgtacgggtcattaaaaaaaccttgcatagtatgcaaggttttttattatgcgttcatagcgtaaatggtaaaagacaggtatgtggcaaaagcgctccataataaataaggaaccagaagccaggctgaagctttactgtatttaccggcaatgagcaacagaatgagtgttgtcacagccacaagcaggcaatcgatagatgcagcaagcaaatttttctgtgtgaattgaaaatagctgaatccttgattcacgatataattgatgaggagcatcacccaaaaagctttggattctttacatgaaaactttgcatatattaaggctgctgagagcgaaataagcgcaaacaaaaccgcccatatgatgcctatcactgatccgcccggcgtccagtcaggtttttgcagcgcgtcgtaccattcccggtcgatgggaaagagaaaccctgctaaagaaaacaagacatatgtaatgataaatacaataatcgcaccgatatacttctttttcatttgttccctccgtcattcaatgtcaatacgttagttccctttcttggaaagattaaaccgttcaaaaggttcatgcaccattaagtgtatgagttttcggtgtgaaaatgcagcaaaccaattatttgtattcaaaaaccccggcctgccggggttttaatcagcatgaaggtcgccaaaggtcgtcataattccttcttcgtccagttcctgctcatatttttcgtgtgccttgcttggatacacggaaatgttttttccggtaatatctgtcgcgataaagttttcataatcctcagcatagccgatgttttcttctgagttcattgtcatatcaccatagctgagcggcggatcttctaaatcctgaggcgtttctgagtttccgtattcctcaacatcctgataagcatcttcactatcgtaagccgcccggattgattcatcatcatcaaattcaaactgtccgaacggtgtttcctcttcaatcggcctgtctttggaaacggcatcctgcgaggaatattccgccaatgtcgtagccgtcggcagagcttcgagtctgtcataaggaatgtccttgccgctgacttcacaagtgccgtatgtgccgttctcaatttgtttcagagagtaatcaatatcgcgaaggtgctccctttcatggtcgagcagagccaggtctttttcccgctcgtataattcggtcgcctgatcgccgggatgattgtcataggaagacaattcgccggatgattgatacgggaattcatcagttaactgaaattgatcattttctttaaagcggcttaaaatatcatctctggcttcttccaattctttttttaagtgtgtgatctgttcgtttgtaagcacatcaatccctcgtttctatgtgatgcttactgttagtatgaacgtttttacgcagaaaaatggtggataaaaatagtcattttcccacgaggaagtaaaaggatacagtgattgccgagagtggggaaagaaaattcaagtttgtttctttattcatttgcgcaaaaaggtttataataagaaatgcaggcattttgtcgtgctcaaatctgtgtgtttgacacaaattcatcacaggtgtattgtattaaaagcatttaacggattatggaggaatgtctcatggtgacaacggtgcagcatacgttccgagaggaagcagatcatgcattacataaagccaaacaagtcaaccatgctgtcttattgagctattcaagacgtattgcgtctttagaccctctatcatttttcaaagacggagcaaaaaaatataaaggcaaacgatttttttggtcagaacccggtagtgaattaacaatagtcggtcttggcacagaagcgctgttccaatcgaatgaaaaaaatggaaaacgttatcacgacgtttttgaacaatgggagcgctttaaaaagacggcttttcatattcatgaagaagaagaggcggcgcataccgcggtcggccctgtcttattcggcggtttttcatttaatcccgctgaagagagaggagacgaatggaacgggtttgaagaaggactgttctttatcccttcactcatgctgacaaagacggcagatggcgattatttaaccgtcaatcaatgggcggcagacggtaatcaggcagaagatacgctgaaacgtctgaaatctttttcagaagcttttgcagtttcttcaattgagtatgaagaatatcctgttttaacaaaagcggaagaacttgatgtggaaaactggcttgaagccattaaaacagcaacaaatgatatgaaggcaaatcaatatgataaagtcgtgctggcaagggaagtcgttttgtcatatgatgggcctattccggcggagagcgttgtccgcaagcttttgacggaccaaacgacaagctatgtttttgcgattgagcagggagataaatgctttgtcggcgcttcaccggaacggctgatcaaaaaatcaggcaaagacgttatgtccacctgtctggcaggttcaattaagcgcggagaaaatcaacaagaagatgaccgtctcggcaaagagctgctgcatgacgaaaaaaatctcgcggaacatgattttgtggttaagatgatacacgattctttcttgtcgagctgcagtgatgtgaaaaagcctgcaggcccgcaattatataaaacaaaaagtgttcagcatctatatacgccgatcacaggccatctgaaaacgtccgcttcgctgtttgatttaattgaaaagcttcatcccactccggcattgggcggagctccccagcagaaagctgttgaagttatcgctgatattgaaccgatgacacgcggatggtacgcggctccgatcggctggatggacggcagggaaaacggagaatttgtcgtggctatccgatcagggctgattgaaggcaaaagtgcgcggcttttcgcaggctgcggcattgttgaagattcagatccgcaatcagaatatgaagaaacacaaattaaactaaagccgatgatctctgctttaggaggtgaaaggctttgacaaacccgattacacattatatcggaagctttattgatgaattcgcactatcgggtgtcaccgacgcggttgtttgcccgggatcgaggtcaactcccctggcggttttggcggcggcccacccggatattcaagtccatatacagattgatgaacgatccgcaggttttttcgcactcggtcttgcaaaagcccgccagcgtccggtcatgctgatttgtacgtcaggaacggcagcggctaacttctatccggccgtgattgaagctcattattcaagagtgcctcttattgtcctgactgctgaccggcctcatgaattgagggaagtgggggcgcctcaggcgattaaccagcattttctgttcggtaactttgttaagtttttcacagactcagctctgcctgaggaaaatcctcaaatgctgagctatgtcagaacattggccggcagagccgtaagtgaagccgggaagcgcccgatggggccagtccatatcaatgtgccgctcagagagcctttgatgccggatttatcagccggaccttttgaaagaatgagaaaggggaagcatgtctcagtcacaacagggattcagtcagctgatcaagactctctctgtcatattacagagcgtctcgcgggtaccgaaagaggtatgatcgtctgcggcgaaattcacggtgaagcagaaaagcagcaaatcatcgcgcttgccgagatgcttcagttcccgattttggctgatccgctttcaaacctccgaaacggggagcatgataagacgctgattattgatgcttatgactcgttcttaaaagatgaagaaataaaagaggcgctgcgccctgacgctgtgatccgcttcggtccgatgccggtttccaaaccgctctttttatggctcagagacgatcctgccattgagcagtttatcgtcgatgaagacggaggatggagagatcccacccaggccggcgcgcatatgattcattgccatccgtctgtgtttttggaagcggtccgttcagctgaaaccggaaaacggccgtccggatggcttgagaaatggcaatttgtcaatgaccggttccggagtcatttacaggccgcgagcatggatgatttatcatttgaaggaaatgtatatcgtcagcttcagcaccttgtccctgaaggcagttcgatttttgtcggcaacagcatgccgatccgcgacgtggatactttctttgaaaaacaagatcgttccttccgtgtctatgccaaccgcggcgctaacggcattgacggagttgtctcctcggctatgggactgtgtgaaggtacaaaagctcctgtcacgcttgtcattggagatttatcgttttatcatgatttaaacgggctgttagcggctaaaaaacttggaattccgcttacggttattttaataaacaatgatggcggcgggattttctcgtttttgccgcaggcatctgataagactcattttgaagaactgttcggtacgccgacgggtcttgatttccggcatgccgccgcactgtatggcgggacatatacttgtcctgagacatgggaagcatttaaggatgcgtatcagccgcaggcggacaagcccggacttcatataatcgagctgaaaacagatcggacatcaagagttcaattccatcgcgatctgctgcaggccgcagtgcgggaagtgaaaaaagaatggaaactgtaacagttaaaacggccgacggcgtatgctatcgtgctgctgatagcggacacggacacgaatcgtctgaagctattgtttgtctgcatggatttacgggcagcaaagaatcatggatgtttttacgcggcatgtttcccggcgagcgaatggtgatgattgactgcctgggtcacggggagacagacgcgcctgtacaagcggcaaggtatagtgcgagccggcaggttgcggaccttgccgccgtttttgatcaattaaaacttcacaaagtgaaacttattggttattctatggggggaagacttgcgtattcctttgcacaggcatttccgcatcgggtgtcagcgcttgttttagaaagtacaaccccgggcctcagcacgcttcaggaacgcaaaaaacggattcagtcagaccggaagcttgctgactttatattgcgggaaggtgtaacatcgtttgttgattattgggagagcattccgttgtttgccacgcagctttctcttccggacagcgtaaaggcgtccatccgtgccagcaggctgaagaataatccgtccggacttgcaggaagcctgctcggaatggggacaggctcacagccttcctggtgggaggcattacaccgcatcaaggcgcccgtcctgctcatatgcggtgaatgggatgaaaagttttgcgctattaatcaaaaggtgcataacctgctcccatcaagtaaaatagaggttgtcaaacaggcggggcacacggtacatgtggaacagccgcgaatttttggtaagatagtaagtgagtttttatacggcttgtaaagcataaagaaaatagcttttcggccggactcaggcaaaaatgaaggaggtcatatcaatggctgcagaatggaaaagtgaacgtcagtacgatgaaatcctgtacgagacgtataacggtattgcaaaaataacaattaaccgcccggaggtacataacgcatttactcctaagacggtatcagaaatgattgacgcgtttgcttgtgcgcgtgatgactccaatattggtgtcatcgttcttgcgggagcgggagataaagcattctgttcaggcggagaccaaaaagtccgcggtcacggcggatatgtcggagacgatcaaatcccgcgtctgaatgtgcttgatcttcagcgtttgatccgtgtgattcctaaaccggtcgtagcgatggtatcaggctatgccatcggcggaggccatgtgcttcatatcgtctgtgatttaacgattgcggccgataacgcgattttcggtcaaaccggcccgaaagtgggaagctttgatgccggttacggctcaggttacctggcgcgtatcgtcggacataagaaagcccgtgaaatctggtacctgtgccgtcaatacaacgcgcaggaagcgctcgacatggggcttgtcaatacggttgtcccattagagaaacttgaagaggaaacaattaaatggtgtgaagaaatgcttgagaaaagccctacagcccttcgtttccttaaagcggcatttaacgctgatacagacggcctcgccggaattcagcaatttgcaggagatgcaacgcttctttattacacgactgacgaagcgaaagaaggccgtgattcctttaaagagaaacgcagtcccgatttcggtcaattccctcgttttccgtgatcagatgacactacgaaacagcttgagccgctctggtccaagctgttttcttttcaaaaacagtacttttacctcggagatgataacatgctgacagaacagccgaattggctcattcaaagggctcagctgacaccggagagaatcgctctcatatttgaaaacaaacagatgacattcagagaattatatcatgcttctaaacaaatggccgcgcggctgtccaaatactgctcgcttaaaaaaggagacagggccgcgattttgctttctaacagaccggaaatggtttatgccgttcacgcctgcttcttattaggggcggaagctgtgctgttgaatacgaagctctcaaaacaggaacggttgtttcagctcgaagattcacaggcaaagcttttattgacggaggacggtttttgccgcgaagaatatgaatctgcggtcgccaccgcagatgtggacgagctgcaggctgaagaggcgggtgacatggagccggaagcttatgtaacgcttgatgatacggcgactcttatgtatacgtcaggaacaacaggaaggccgaaaggggtgcagcagactttcggtaatcattattccagcgctgtatcgtctgcgctgaatctgggggtcacggagcgggaccgctggcttattgcgctgccgctgtttcatatcagcggtctgtctgcgctgtttaagtcggtcatttacggcatgcccgtcgtgcttcatcaaaaattctctgtcactgatgtgctggacagcatcagctcccatcaggtcacgatcatttcagcggtgcagaccatgctctcgggcctgcttgcggaaactgaacaatgtcctgaatcactgcgctgcattctgcttggcgggggtccggcaccgctgccgctccttgaagaatgccgcaggaaacaatttccggtattccaatcttacggcttgactgaaacctgctcacagattgtcacactttctccggaattcagcatggacaagctcggctcggccggtaaaccgctgttttcatgcgaaattagaattgaaaaagacggaaacccttgtgcgccgtttgaacatggtgaaattacggtgaaaggcccgaatgtaatgaaagggtattatcatcgtgacgacgcgaaccaggccgcttttcataatggatggtttaaaacgggcgatcttggctatttggatgatgaagggtttttatacgtgctggacaggcggtcggacctcatcatttcaggcggagagaacatctaccccgcagaagtggaagcggcgctgcttgcccatccggctgtagcggaggccggtgtttcgggagccgaagatccgaagtgggggaaagtgccgcatgcttttctcgtgctgacttcttctgtcagttctgaggagctgaccgccttttgccgtgagcggcttgcaaaatataaaataccagctgcttttttcaaggttgacgggctcccgcggaacgcgtccaataaactgatgaggcatcggctgaatgagcttcgtaaaggagaattgtcatgattaagattgaaaaaatcaccctttatcatgtaagtatgaggctgaaaaaaccgtttaaaacaagtattgaaacgctgcaggatcgtaaatttttgatcgtggaagcgatcgatgaaaccgggagaaccggctggggggaggtatcggcgttttcttctccgtggtatacagaagaaacgattcagacatgcgcgcatatgctgagagattttttcatcccaaatgtcgtaggccgcgcgtttttccatccgtcagaagtgcctgacagtctcgcgcgtttcaaaggaaaccgcatggcaaaagcggggcttgaatcagccgtgtgggatctatatgccaagaaaaaggggatatctctcgcagaagccttagggggcaaaagagataaagtgcccgccggcgtggtggtgggtctggcttcggctgatgagatgcttcgggaaattgagcaatacgtaaaagaaggttatcaacgtataaaaataaaaattcagcccggccatgacgttgatctggtcagagccatccgcagccgttttccgaacgtgccgctgatggcggatgccaactcggcttatgaactgaaagacatcagcaggctgaaagagttggatgaattccagctcatgatgatagaacagccgcttcaggcagatgatattgtcgatcaccgccacctgcagaaacacttaagaaccgcggtatgccttgatgaaagcatatgctcttatgatgacgcaagacgggcgattgagcttgggagctgtaaaatcattaacataaaaccggcgcgtgtaggaggcctgacagaggcattaaaaatacatgacttatgcagagagcatcacatgccggtttggtgcggcggaatgtttgaaaccggcatttcgagagcgcagacagtcgcgcttgcttcgctgccgcaatttaccataccgggtgatatttcctcatcagaccgatactgggaggaggatattgtcactcccgacatccgtatcgaagagggattcatctctgtcccggacggtcccggactgggtgttgaagtcaatcaggaaataatgagaaaatacgtcacccaaatggacgtttttacgacaaacaactgataaaaagacatttcagcgagttgagctgcctgtatgctgctgttatattgaaactgttcattatcaccccttcccccgtttgaaccggctgtatcagccggtttttttaataggcgaatgcgatgatttttttattcttcaaacagtgccggctttacatcgcaggtgctgctttccggctggggcaaacatgtacatcttgataaaaaattctgtgcttgtcatgaatgcgatactgattgtaccgtctgccgcctatatttgccgccgaaccgcctttttgccatgcttctcatccgcgcggttttctccggctcagggaggcttgcggcggaaatgaaaaagagctgtataaaacagctcttttcttttataaatcttgcggtttaaaggttttgcaatccgtttcttcacttttttcagcggtttcgcctgtatggctgaccacataaatagcgtcggccgtgcatttgtttcctctgccccaatatgaacagttattgacttcacacagaattttttggtccatgctggctcccctccaagataaaaggtacgccattagtatgagccgccctgatttttgttattcctcctggcggatataacgtctgtctttcataaagagcttccagaagaaataaaacccggggaacaaaatgatgaaagcgacgatatacgtcataaacagcgccctgaaggttgccggctccgtaaatcctgacatgaccgtaatatccggataaatcatataaggaagatgagcccgtccgtatgcatagcttgccagaaagtattggagcgcaatggcgatcatggcgattctcggtttgccgaggttgcggccgaagcgcttattcggcaaaaacagagccacgccggcaatgataaatgtaatgacagacagaatgagccatgtcttgtctttcatcatccccgtatacagccagccggcttcagagcgtaatgtcagcataatgaagaaggcaaacagaagcgacagcggccctgttattaaagagctccgtctgtagatgcggtacgcatgctcctcttccgcaacatttgaaaaatcggccagaagcagtgaagataaaaataaagtgcttaaaatggcaaagccgataaacgcatacgcattaaggcttgtaaagacatttgccaaattcaggtgatacactccgcccgtcttctcaataaaccctccgtgtgtgaccggaaggaccaaaatcagcacagcgggaataatgaagcctgaaattccggagatatatctcatgatttttctttccttcgccgtattggagaagacgagaaagccgctgcggatggctaagagcagcaaaataatacttcccgggatcaataaaacggttcccagcacgaaggttgcccctggaaagaagctgaatagggcgacaacgatcgcgacgataaagacgttggtcacttcccatgtcggggacaaataacggttggcgatgtttgtcgcctttgtttgttctttatttaaatatatcatcgaccaaaagccggctccgaagtccatcgttgccatgaccgcgtagataaacacgaagccccatacgattgatatcgcaatgagagcatccatggtaatgtccatttcaattcagccctttctattgttaggattccgccgcttttacatcctcctcaacaggatgtttgcggaaataataaagcagcacataaatgactgcggctgccaaaatggcgtaaaccactgtgaacaggatgaacagcaaaccgattgaaccggttgtcgtgacgacatcagacgttttcaggagatggtaaatcacccatggctgccgccccgtacaagcgaatatccacccgaattcaattccgatcagactgagcggtcctgcggttaaaaataaaatcaaaagccaagtcggaaagctgtctttctttaaaatttttctccacacgatgccgatgatggagtacaaaatgagcagcatcccgatgccgaccattccgttaaacagtgtatggatgaataaaggcggccattcgtctttaggaaacgcgttcaatcctttgacgacggtatcaaagctgtttgcggccaaaaagcttaaagcccacggcacttctatcgcccattttactttttcttcttttgcatcagtaaaacccccgatcgcaagcggagcgtgtgatctagtttcaaacagcccttctgcgcccgcaagcttctcaggctggtattcgtaaagaagctgggctgactcgtgaccgtttaaagaagcaataatagagaatatcccgccgatcgttaaagcgagcagcagcgcttttcggtgaaagcggtatacctgctcctgttttctcgttctcagcattttataagccgcaactgacgcgacgataaatgcaccggtcatgaaagccgtcagtacgacatggcccgcggtggtgaaaaagcttggattaaaaaacgctgtccacggttcgacgtcagtgattttgccgtttaaaattttaaagccggccggcgttccttcaaatgcgtgaacatttgtgattaagacggcggatgccgcggcgccgatcaaaacgaaaataacggcaatgatgcgcatcgccggggtcagccggtcagcggcgtagacataaatggacataaacagcgcttcaataaagaaagcataaatttcaatctgaaacggaagtgacatcaccctgccgatgacctccatgaatccgggccacaaaagggcaagctgtgtacccgcgatcgttccggtcggtatcgccacgccgagcagaacagcctgcgccttcgtccaccttttcgccataatggcataatgcggatcttttgttttttgataaatcaattcggccattaaaatcatcagaggcaagccgacaccaagcgtcgcaaaaataatatgaaagcccatggttgtcccgaacagacttctggctaatactaaatcatccacgatcataaaccgcctttctaaattaccgttttatgtaatgtggttatattatttgctgaagcgattagattattcttccgattccatatatgtgcagggtttagaaatcaagggatcagggcatatatgattgacaagcgcctatttaaggtttagaataaaacgtaattattacgatttgagaaagggagatcaccatgaaaaaagatattcatccggataaccaccaagtgatttttcaagatgtgaacagcggctaccgctttttaagccattctacgaaaacgtcagaggaaacggcagagtgggaagacggaaaaacatacccgctgattaaagtggaagtcagctcagatacgcatccgttttatacgggccgccaaaaattcaacgaaaaaggcgggagagtcgaacagttcaacaaaaaatacaatatggggaaataagacaagcccaatagggtttgtcttatttattgagcactttatcatctcgtgcggggagtgacgaaatgccccgccttatgttatattgtgaataaaaaagcagaaaggaaacaccaagatgagtcttctaaacgatatcatgcaatttaatgagcagttcactaaaaacaaagattatgaaaaataccaaacatctaaattcccggataaaaagatggcgattttgtcctgtatggacacacgtcttgtagaattgcttccgcatgcgatgaacatgcgaaacggcgatgtgaaaattattaaaagtgccggcgcgcttgtcgcccacccgttcggaagcatcatgcgcagccttttagtggccgtatacgaattaaacgctgatgaagtctgcgttatcggccaccatgattgcggcatgagcaaaatcaacagcgaggatatgcttgataaaattatcgaccgcggtattccgaaagagcggattgacatgctgaagcactcaggtgttgatcttgatcaatggctgaaaagctttgattcagtagaagcgagtgttacagacagcgtaaacgtcattaaacaccatccgctattccctgacaatgtcccggtgcacggtctggtgattgatcctgaaaccggtaaacttgatctggtgatcgacggctaccagcatatggactaatgtttttgttttttgtccggtacgggatcaacaccgcccggatgaaaagggtggcactttaaaatccgcttcagtgtcagccatccgccttttaatgcgccgtgagtcttgacggcttcgattccgtactgcgaacacgtcggataaaagcggcatgacggcggcgtcagcggagagatgaacttctggtatccgcggatgagcgcaatcattatggttttcattaaaaaaccacctttctgatgctagtatagaaaaaaaatttcagattgaaaagcttccgccacaattcttatcggaaaactgtgttataatggatgcatattctgaaaaaaaagggagtgccattatgccttcagtagaaagttttgagctagaccataatgcggttgtggctccgtatgtaagacattgcggagtgcataaagtcggaacagacggcgtcgtgaataagtttgacattcgcttctgccagccgaacaaacaggcgatgaagccggatacgattcatacgcttgagcacttgcttgcgtttacgattcgcacacattctgagaaatacgatcacttcgacatcatagatatctcaccgatgggctgccagacaggctattatcttgttgtcagcggcgagcctacagcggaagaaattgtagacctgctagacgctacgctgaaagaagccatcgatattacggagattccggcggccaacgaaaaacagtgcggccaggcgaaacttcatgatttagaaggcgcgaaacggctgatgcgtttctggctgtcacaagataaagaagatttgctgaaagtgttcggataaaaaacaggcctttttgctgacatgcaaaaaggcttttttacatatttctaaaaaatgtcacaccttatgtgtaagcgtttgctaaaatagaagcaaacatgaaggagtgatgggatgaaacgggctgtattggcaggtatgtgcggtatggtatttctattatcttcctgcgggggtaattcggacaaaaccgccgcggatgaggagcctaaagcgcttgaggtcaagcttacaggaccggaaaaggcagcaccgcatgaaaaaacggaatacaaggcggaggttttttacggcggcaagcgtgtcacggatgcggatgaagtcatgtttgaagtatggaaagaaggaaaaaaaggcagcagcaaaacaagcaaggccaaggaggaaaaaggggcgtatcacctgcggactgaatttgatgaagagggtgtgtataccgttcaatcccacgtaacggcaaaacagcagcataatatgccgactgtaaaagtgcgtgtcggggatgctgaagctgccgatgattcctccggccatgaggaacagacgcatcatcattaaggattgtttttatccgtcaagccttttgatgcgtcctccggcgggtcaatcgtatgttttacgttataagctcttacagtcgaccagatggataaaagcagcacggcgagcacgataagaaagccgaagctcagaagaagcagcatgaaatccctcctttttaacaaatcataacatattttccatccgtaaaatcaagggctaaaaatttatgttttaacacacgatatatagggtatatcaatagtaaatcaaaggaggaagataggcatgtcagaaaaactattggaagcggtcaataaacaagttgcaaactggacggtcatgtatgtgaaattacataactatcattggtacgtcaaagggaaggactttttcacattgcacgaaaagttcgaggagctgtataacgaaacggctacatatattgatgatctggcagaacgtctgctggcattgaacggcaagccgatcggcacaatgacggaatcattgaagactgcttctataaaagaggcggaaggcaatgagagcgcagaacaaatggtacagaacatttatgatgatttcactgtcattgcggaagagctgaaaagcggcatggatctcgcagatgaggtcggagacgaaacgaccggagatatgctgcttgccattcaccagaatatcgaaaaacataactggatgctgaaagcgtatttaggataatcaacaagggaagaccggggctataaagcactcggtcttttatttggctgccgaagagaggtgttgtccatttttctgaaaaatccagtccgttccattcacttttcatagaataatgtaaggccgtttctgtgaaaggatgttggatcaagtgggcaaagactttggcatcttttcgttttttgcagtgatcgtgtcggcagcggggtttttctttggcggttttcagtattcgtttctgattttgctatcggtcatggcgattgagtttatcagtacaagcttaaaagaatctcttttgcagcagctgagcgcaagaaagctttttgcgcggctggtcaaaaaaatcgtgaccctggcattagtctcagtttgccatttttttgatcagctgcttcattcagaaggcgctatccgtaatttggctattatgttttatatcttatacgaatcggttcagatcgtggtaacggcaagctcgctgggcatcccggttccgcaggtgctcatcgacctattggataccctgaaaaataaattcaagcgcaaaccgtaacatttgcttcaaaggaggctatactagcgggtatgatggttttcctctgaatttttgataaagggcttccgaacaaacgcaactgtggtatgatgtatggaagatatgaaggaacggattagagggataaacatgtacgagtttaaagactattatcagaatactgttcagctctcctttgaacaccagcctttttcagacagcccgaagcatgtatgggtcatatgccgatatggagataagtggcttttgactgagcacgaagaccgggggtttgaatttccgggcggaaaagtggagccgatggaatgtgcggaggaagcggccctgcgcgaggtgaaagaagaaaccggcgccgcggtaagacatctgaagtacgtcggacagtataaagttctcggcagggaaaaggtaatcgtgaagaatatttattttgccgatattgaaaagcttgaaaaacaggcgaactattttgaaacaaaggggccggtgctgttcagcgaactgccggagaatctcccccgaaataaaaaattcagtttcattatgaaagattcggtgcttccgatcagtctgaaaaagctgaaagaggacggcgtatttcaatcataaaaaacggagacccggcgcttacgcacgggtcttttttatatttttcctttcgtccattttctttctaacagttcgactccctgatacatcaatgtcgcaaaaatcgcgatgatcagaaggcttaagaacacaagagtgaaattgaagacctggaatccgtaaatgatcatgtagcccagacctttttcggaaacgagaaactcgccgacgatgacaccgacccaggataaaccgacgttcactttaagcgcggaaataatcgcgggggcgcatgccggcagaatgacttctttaaacatgatgcttcttttcgctccgaaggttttcatcaccttaatatagttttcatccacttcctgaaaagccgtaaagacgacgattgtcgtgataatgacactgatgactgctcccatggcgacaatgcttgtgaaattcggtccgagtgccacgatgagaatcggtccgagtgcgaccttcggcatcgcgtttaaaatgacgaggtacgggtctaaaacccgggcgagccggtttgaccaccataacagagcggcgaggcatgtgccgagaagcgtgccgagcaaaaagccgagaacggtttctactaaggttacgccgatgtgcgccgcaagggatccgtccgcaatcttttcaactaaaagcctgtaaacggcggagggtgagctgaagattaacggatcgatccagcccgccctgctcgatatttcccacccggcaaaaaatacgatgaaaatggcggcctgatacgcacggatccggagcttttctttttggtgtcttttcttaaactgctgatgaagctgttcaatcgtgccgctgctgtttttcaagggaattcagctccttccatatggtttgaaacagcggctgaaaggccggatcctgacgcgcgtcaaacggatctaaagccgcgagctccttaggcacggtgaatatttggtggatggtgcccggctgattcgaaaataaatagatcgtatcgctcatggcgatggcttcaccgatatcgtgggtgacgagcacggcggttttttgaaaatcctttaatgttctgaagacaaggttttccaaagaaagcttcgtttgaaagtccagcgcggaaaacggttcatcaaggagcagcagtccagggtccggcgcaagagttctggcaagtgccgcccgctgccgcattccgcctgagagctctttcggatatttcttttcaacgccgattaatccgagcttaggcagaaggctgagaacttcagctcttttttcttctgttaatgtttttgaaatgtgtaaaccgagcagcacgttttcctcaattgatttccaaggaaataaataatcctgctgaagcatataaccaatttggtgttctttatggttcggcacgcttccttcgatcagcacccggccttgcgcaggggtgataaggccggccagaatggacaggagtgttgtttttccgcatccgctcggcccgagaaaggagatgaaatcccctttttcaatctgaaaatgtatatctttcacggcggttgtcttttctttcagcgagaaataagtatgtgttacatgatccacatgtaaaaaagacattcatgttcctcctattgttctgaggtgacttttttggcgatttttgtgttgacgagtttgctgtacggaatgtgtttcgggagctctccggcttcatccataatagattgaagcagttcccattcatccttttgcagaactgggtctgcagagaatgacttttgttttttatagcgctctatcgatgtttcgataatggccgggtctgtatcggcaaattccttctgaatcgtttttgcgatgtctttagccggatggctttccacccattgctgggcgcgatagatggcgcgggtgaatttttccgccgtcttttcattgtttttcaaataactttcttttgccataaaggttgtgtatggcacttggccggaagcttctccgaaggatgcgacgatatgaccgatgccctctttttcaaattgggatgccgtcggttcaaacagctgcacataatcacccgttccggatgcgaatgcgttggaaatattggcgaaatcaatgttttgaacgaggttaatgtcttttttcggctctatgtgattctttttcaggacgtactcaccggccatttggggcatgccgccttttcgctggccgagaaatgtttttccttttaaatcgttccatttgaatgatttctcatccttccgcgacacgagaaatgtgccgtccgtctgcgtcagctgcgcgaaattgatgaccggatcttttgctccctgcgcctccacgtaaatggatgtttcagaaccgaccagcgcgatgtctgacccgtttgacaaaagcgatgtcatcgttttgtctccgccccatgttgtttgaagtgacacttggagcccttcctttttaaagaaaccttttgcttcagcgacatacagaggcgtatagaagatggagtgtgtgacttccgccacctttaccttcgtcagactttcttcctgtctgcaagccggaagaatgagcaggaaaaaggcgcatatgacaaaaacgcagcccgctttgagccatttgttcacggtgtaacctccttgttttaagcgttaaaataaccttttctgctttacatatcgtatgatgggtataaaaaatgtgtgagtgcccatattcacgttgggaaagaataaaaaaactgatgatctaaggaggcgcattgttttgctggtagaaaagaaaaggttcccgtctccgagtccgcatgtccgcctctttgcggtatgctatgagtcagaagggctgaaggtaaaggggctccttgccgagcctgcggcgccgggaacatatgacggttttttatatttgcgcggcggcataaaaaatgtcggcatggtacgccccgggagaatcgttcaattcgcttcccaaggctttgtcgtgtttgcgccttattacagaggcaaccagggcggcgagggaaatgaagattttgcgggagaggacagagaggacgcgttttccgctttccgcctgcttcgggagcatccgaacgtcagggaagggcgggtgcatattttcggtttttcccggggcggaatcatggggcttttgaccgcgattgaaatggggcatcaagcggcttcactcgtttcatggggcggtgtgagcgatatggtgctgacttatgaagagcggaaggatatgcggcggatgatgaagcgggtgatcggcggcacgccgaaaaaggtgccggatgaatacagatggcgttcgccgtttgaaaaagcagaccgcattcaggcccctgtgctgctcatccatggagagaatgatgaaaatgtttcgatcgaacacgcccggatgatcgaggacaagctgaaagaggcgggaaaaccggtggaaacttggtattacagcggttttacgcattattttccgccgcaggaaaacagacgcattgtccggcggctggcggaatggatgaagacacggtaagatgcctgatttatgatatgataataaagaataagagaatgaaaggggattttcattttgggaatgcctgttgaatttaataccatgattgtgacaaaaggcaatgaaaaacggatagaggaaaatatctttttattggagaaagagggctaccgcgtctatcctcttgatattccgatggacgtgcgcaaaacgaaaaccggagagaaatccggcaccggcgaggtccaaaagctcgaatgggcgaacggccggacaagcattacatacagactcacttcgcttcattcgacaaactgaaaaaacaaaagccgagggcataaacgcccttggcttttttgattacacgagaggtccgccggttttggcaatcgagtctgcatgggaaaactttttaaagttttctttaaactcattggctaaaaacagcgctttttcgttgtatgcttgtttatcgctccatgtgttttcaggctgaagaacttcatccggcacgcccggaacatgaacgggactgtgcaggccgaaaatgctgtctgccgtcatgtcagtctggttcagtctgccgtcaatagcggctttgaccatcgctcttgtatacgaaagtttcatccgttctccgactccgtaccctccgccggtccagcctgtgttgaccaggaagacttgaacgccgtgttcgtcgattttatgcccgagcatttcggcatatacatgcgccggaagcggaaggaacggtgaaccgaagcacgtcgagaaagtcgtttgcggagatgtcacgccgcgttcggttcccgcgagtttactggtgtatccgcttaagaagtgatacatcgcctgttccttcgtcagtttgctgatcggaggaagcacgccgaatgcgtccgccgttagaaagacgatcgcctgcggatggccggcaatgctcggctgcacgatattgccgatcatctcaatcggatatgcggctcttgtgttttccgtgtagaaggaattgtcgtaatccgcttcacccgttttttcatcaagcacgacattctcaagaacagacccgaagcggatcgcacgaaaaatctgcggttctttttcctcgctcagattgatacatttagcgtaacatccgccttcaatgttgaaaacgccggaatctgaccagccgtgctcgtcatctccgatcagtttgcggtccgcatcggctgaaagcgtcgttttccctgtgccggaaaggccgaaaaacagggcgacatcgcctttttcaccgacgttggctgagcagtgcatcggcagtatatcctgctgcggaagcaggaagttcataatggagaatattgattttttcatttctccggcgtattcggtgccgccgattaaaatgacgcgcttttcgaaagagacaatgataaatgtttccgaatgcgtgccgtccgtctccgggtctgctttaaaatgcggagctgagagaatggtgaaaggctgcgcttgcgggtctctttcatccgtttccggtctgataaacagctggcgcgcgaataaattgtgccacgcaaattcatttacgaccgtaatcggcagtctgtatttttcatccgctcccgcgaatccttcaaacacaaacagttcatcccgctgttttaagtagctgacgactttggcgtacagcttttcaaacgcctcttcagaaatgggctgattcaccgcgccccaatcaatttgattttctgtgctttgttcacggacgataaatttatctttaggtgaccggcctgtatatgcgccggtagtggcgcgtacggcgcccgttgatgtcagcgttccttcatttcggctgatcactttttcggtaagttttggagccgataaattatgatgcacattcggacttgcaagtaatgcttgaagatctgcggttaaatcaactaatttcataaaaaccttcctttgccggtttatttgtatttcgctgaatgtggaattagtataacatatatctgaaaatagtctatactatttacggttttttgtttgtgtttttccattgcttcccgaaataaaggcgcgcaatcgctttaattcatattgacactttccgcccttttacgataagatatttcattgagcggatactcttatcccgagctggcggagggacaggcccgatgaagcccagcaaccggtttctctgtaaaaaagcaggtgaaaacactgtgggaaaccaaggtgctaacctgatgcaaggtttaatattttccttgagcgataagagtgaaaggcacacagaccaaaccctttcctcgagtggaaaaggtttttttatttcataaaatatgccaattaacattctctgatatagtatgacattgtattaagagggagcgagttccgtatcatatgagaaggtcttgcaaaagatcttttttcaggaggaaaagtgaatgagtaaaaaccgtcgactatttacatctgaatctgttactgagggtcatccggacaaaatctgtgaccaaatttctgacagtatcttagatgagattttaaaaaatgacccgaacgcgcgcgtggcctgcgaaacatctgtaacgacaggacttgtgctggtaagcggagagattactacgtcaacctacgttgacattccgaaaacagtccgtgaaacgattaaagaaatcggctacacacgcgccaaatacggatttgatgcggagacttgcgctgttttaacatcaattgatgaacagtctgcggatatcgcaatgggtgtcgatcaggcacttgaagcgcgtgaaggcacaatgagcgatgctgaaatcgaagcaatcggagcgggagaccaaggcctgatgttcggttatgcgtgtaacgaaacgaaagagcttatgccgcttccgatctctttggcgcataaactagcccgccgtttgagcgaagtccgcaaagaagacattcttccgtaccttcgccctgacggcaaaacgcaagttaccgttgaatatgatgaaaacaacaagccggtccgcatcgacgcgatcgttatttcaactcagcaccacccggaaattacgcttgagcagattcagcgcaatctgaaagagcatgtcattaaccctgtcgtgcctgaggaactgatcgatgaagaaacaaaatacttcatcaaccctacgggacgtttcgtaatcggcgggcctcaaggtgatgcgggtcttacgggccgtaaaatcatcgtcgacacatacggcggatatgcacgccacggcggcggcgcattctccggtaaggatgcgacgaaggtagaccgttcagcggcatacgctgcgagatacgtagcgaaaaacatcgtggcagcaggtcttgctgattcttgtgaagtgcagcttgcatacgcaatcggcgtggcacagcctgtttctatttccatcaatacatttgatactggaaaagcttctgaagaaaaactgatcgaagtcgtacggaataacttcgacctgagacctgccggcattattaaaatgcttgacctgcgccgcccgatctataagcagacagctgcttacggccacttcggacgtcatgatgtggatcttccttgggagcgtactgacaaggcggatgcgcttcgcaaagaagcactaggagaataattttatagccgcttacttaagcggctttccctttttgtagatgctgccatgcttattttttacatagcgtgaaaccaatggcgtaacaaagcgtctataaaaagggggtccaattagaaaattacacttatggaggctatactatgtgtggatttgtcggtgtttttaataagcatccattaactcaaaccgcagatcaagaagagctaatcaaacaaatgaaccaaatgatcgttcaccgcggtcctgacagcgatgggtattatcatgacgagcacgtcggattcggcttcagacggctcagtattattgacgtagaaaacggcggacagcctttatcatatgaagacgaaaaatattggatcatttttaacggcgaaatctataactacattgaattgagagaagagcttgaagcgaaaggctacactttcaatacagattccgataccgaagtgctccttgcgacataccgtcattataaagaagaagccgcttcaaagcttcgcggaatgtttgcgtttttaatctggaacaaagctgaccgcgtcatgtacggcgcgagagatccgttcggaattaaaccgctgtattacacaaccatcggggacaaagtatattttgcatctgaaagaaagagtttaatggccgctcaaaacggtattgatcttgatacagcttctttacagcaatatatgtctttccaattcgttcctgaaccgagcacgcttgacgctgaagtgaaaaaagtcgaaccgggcagccagtttacgatccgcccggaaggcgacatcgcgtttaaaacatatttcaaagcgaacttcaagcctgttcagtctgatgaagataaattggtgaaagaagtcagagacgcaatctttgactctgtcaaagttcacatgagaagtgacgttcctgtcggttcgtttctatccggcggtatcgactcttcttttatcgtttcagttgcgaaagaatttcacccgagccttaaaacattttccgtcggttttgagcagcagggcttcagtgaggttgacgtagcgaaggaaacggctgccgcgctcggtattgaaaatatcagcaaagtcatttctcctgaggagtatatgaacgagcttccgaaaatcgtctggcactttgatgacccgcttgcagatccggcggcgattcctttgtactttgtcgcgaaagaagcgaaaaagcatgtaacggtcgcgttatccggagaaggcgcggacgagctgttcggcgggtacaatatttaccgcgaaccgctttcgcttaaaccgtttgaacgcattccgtccggtctgaaaaaaatgcttcttcatgtggcgtccgtcatgcctgaaggaatgagagggaaaagcctcttagtccgcggctgcacaccgcttgaggagcgctatatcggtaatgcgaagatttttgaagagcctgtgaaaaaacagctgctcaaacattacaatccagagctttcataccgtgatgtcacgaagccgtactttacggaaagccgttcatacagcgacattaataaaatgcagtatgttgacatccatacgtggatgcgcggcgacatcctgttaaaggctgacaaaatgacgatggccaactcattggaactgcgcgtgccgttccttgataaagtcgtgtttgacgtagcttcaaaaattccggatgaattgaaaacgaaaaacggcacgacgaaataccttctgcgcaaagctgctgaaggggtagtgcctgatcatgtgcttaaccgcaaaaaactcggcttccctgtgccgatccgccactggctgaaaaatgaaatgaacgaatgggttcgcaacatcattcgcgaaagtgaaacagatgcttatattgaaaaggattatgtccttcagcttctggaagatcattgtgccgacagagcggacaacagccgcaaaatctggaccgtgctgatcttcatgatctggcacagcatcaatgtcgaaaaaagactggtgccggaagagctgaatcatcagccgaaagaagtcattttcgtttaatccaaaaggctttcgagttatcgaaagccttttttctattgttttttgtaaaccgtctattccgctctgttttcgacaaagtattacgcaatattcagaaaaaggttataataggactaatcgggtagattcctgaaaaagttttctggctatttcgtctcggtttgttgtttctttgtcaaaatcagggggagggagagttatgcaaaacaaagaaaaaacgcttcaccgcggcttggaagagcggcatatctcgcttatgtcgttgggcgccgcgattggagtcgggctgtttctcgggtctgcttctgccataaagcttgccgggccggggattttagccgcttacgcctgcagcggactgattatgttttttattatgcgggcattgggggaaatggcgattcaaaagcctgtagccggttcattcagccggtatgccagagattatatcggcccgcttgccgggtttttaacaggctggaattattggtttttatgggtcgttacctgcatggcggaaatcaccgcggtcggcatttatatgggctactggttccctgacgtgccgtcatggatctgggcgctttgtgcactcgtcattatgacggctgtcaactttctggcggtcaaagcgtacggtgagcttgaattctggtttgcgctcattaaagtcttggcgattctgtcaatgatcgcgatcggtctggtgatgatcgtattcggtctcggaaacggaggcgttgcgctcggaatcagcaatttatggagccacggcggctttttcccgaatgggattaaaggggtgctgctgtcgcttcagatggtcatgtttgcttatctcgggattgagctgatcggtgtcacagccggtgaggtcaaaaatccggaaaaatcactggcgcgggccatagatactgttttttggcgcattctcattttttacgtcggagctttgtttgtcattatgtcaatttatccgtggcaggaaatcggttcaggcggaagcccgtttgttttgacatttgaaaaaatcggaatacccgctgcagccggaatcattaattttgtcgtattgacagcggctctttcttcctgcaacagcgggatcttcagcacggggcgtatgctgttcaatctggcggagcaaaatgaagcacctaaagcatacggtacggtcacaaaaggcggtgtgccgggaaaagcggtattggtttcagcgggtgcgttatgcatcggcgttttgctgaactacgtggtgccggcgaaagtgtttacgtgggtgacgagcattgcgacgttcggagcaatttggacatggtcgattattttgctttcccaaatgaaataccgtaaaagcttacagccggaacaacggaaaaaactcaaatataaaatgcctttataccccttttcctcatatatctcgctggcatttctggcttttgtcgttgtgctgatggcttttgatgcagagaccagggtggccgtcatcatcggtcctgtctggttcggcatattattagccgcctattacggcaaaggtttccataaaagaaaagacatagatctggaaaacggacagacattcgccgaaaaagcgtaaaaaaagagcccgctgaaatgggctcttttttcataggatcgggtaaaagggggaagaataaaacaaattcctgaacattttgcttctgtttcctgacaatcgggagaatgcaaatggtttttacttaaataatattttgaaaaatggtacagtagtaaaacaaagctgatcttttttatttctcttgcattgttttatagtatcggcctttttcaacatattccgttctgattctttccatgtcccgtatgtcttcttctgtcagccggcggataacctttgcgggccggccgaacgcaagacagccgggaggaatggttttgcccggaggaacgagacttccggcgccgataaacgcgccttctccgatttccgccccgtcaagaatgacggagcccataccgattaaagcattctttctgatgattgcactgtgcagtgtaacctgatggccgatcgtgacgtcatcttcaataagaagcgggcggttcgggctttgatgcagacagctcaagtcttgtatgctgactctttttccgatccttgtcggcgcaacatccccccggatgactgccgagaaccagatgctcgattgttctccgatcacgacgtcgcccgttatgacggcgttatccgcaatgaacgcttcaggatgtatgtccggcgtaaattgtttataagggtagattatcatgtctcatccttctttctctaaatttatgtaagaggtgaactgcatgtggacttggaaagcagacaggcccgtcggtaccattgtcattatccacggggcgagcgaataccacgggcgttataaatggctcgttgaaatgtggagatcttccggatataacgtggtgatgggcgatttgcccggtcagggaacgtcgacccgcgccagagggcatattcgctctttccaagaatacattgatgaagtagatatatggattgataaagcgagaacgcttgaagcgcccgttttccttttgggccacagcatgggcggactgattgcgatagaatggtttaagcagcagagaaatccccgcattacggcactcattttatcatcaccttgtctgggtctgcaaataaaagtcaataaagtccttgattttgcgtctaaaggactgaacgtcctcgctccgtccctcagagtggattccggcttatcacctgatatggcaacgaggaatgcggatatgattgaagcggatcaaaacgattctttatatgtcacgaaggtatccgtaagatggtacagagagcttttaaaaaccattgatgccgctatggtgccgactgatgcgtttttaaaggtgccgcttttgcttatgcagggcggtgatgacaaaatcgtcgataaaatgaaagtccgcaaatggttttccggtgtggcttcccataataaatcgtaccgggaatgggaagggctttatcatgaaatttttaatgaaccggaaagagaaactgtgtttaaggcggcaaaagcctttacagatcagtatatttgaattcgctgggggtgcatatgttgacagtaccggaacatccttttaaccttatggcaaaagtgtatcgggaaatttttccgctcgttcatcaggaattgaacatgtggcgggaaaaatcagattccattaaaaatatcgaactgcggcagcaggcggccgcaagtatccgcgataagtcgtttcattgtgaaggaggcggcattttagccctgctttcgggagagcagaaacagaaatgcgtgcaatttatcatcgcgtatcagacaatcagtgattatctggacaatctgtgcgaccgcagcacctcgcttgatccgaaggacttccgcatgcttcatctttccatgcgtgacgcgctgacggtcggtgccgaggtgcggccgtactatcagtacagagaggagcgggatgacggcggttatcttcatgagctggtcagaacatgccagcgggtgctcgggtcaatagaacattacggtatcattaaaccttatttgcttgagctgtgtgattattattgcgatcttcaggttcataagcatgtcgttgagcatgaacgcgttccgaggcttaaagcctggtttgagcagtaccggtcacagcttccggaaatggagtggtttgaattctcggcctgcgccggatcgacgctaggcattttctgtctcgttgcttactcattccagcctgattttaacgaacataccgctgagaaaatccgcagcagttattttccgtacatacaagggctgcacatactgctcgattatttaattgaccaggaagaggatctgcttgaaggcgatctgaatttctgtacgtattatcagtctcatgaagaaatgatgcagagactgcagcattttattgaaaaagcggatgaacatttgcaaggcattccgcatgaaaattttcaccggctgatcaacagggggctgctcggcgtctatttatccgatgacaaagtcgccggccaaaaagaaatgggccgcctcgcgcgaaagctgatcagggcaagcggaaaaacgtcatttttcttttatatcaacggaagagcctaccgcaaatttcagaagatggcttggacgaaaagttcgtaatgggtgaactgcgcctctcgtgtacatcatgacggcgcagttttttatttatgatgtgaagaatgaaacattgtgtgcgcctgcagaatatgatactttaattttatgaaaaaattaaagtatttagcggtcatagcattactttccatttccggaggctgctccgtcacccatgcttccgccggctatcatcctgtcttgatagcgcacaggggctcttctgcgattgagccggaacataccgctttgtcttatgcacgtgcgattaaagacaaagcagattatattgagatagacttacgggagacgaaggacggccgtctgattgcaattcacgataaaacggtagatcggacaacagatggtaaagggatgacagatgatctgtctttggctcagattaagaaactgaatgcgggaaaaggagaaaagattttaacattagaagaaatcatacagaaattcggacaaactgccaattactatattgagacaagagaaagcaacggcagcctggtgatggaaaagaaactgattgacatattacaaaaacataagctgatttccggccataaagcagtcattgagtcttttagcgggaagagcttaaagaaagttcattctatgaataaaaaagttcctcttgttcgattattaaaagataacgaggctgaggagataaatgataagcagctgcaaaccatcagaacgtatgctgatacagtcgggatcaacgccaaattggcaaatgaagcagtcgtgaagcgcattcatcacaataagatgaaagtgcacgtgttttttgataaggaagacgagcatacgctgacgcctattatgctgaaacaaaaagcagatggtgtctttacgaacaatcccgcttatacacgcagcgtgctgcaaaacagtaaataaaaagagacatgcgcattttacgctgtctctttttttaacggtttcttttttgccgcaaggtgcattgcgaatttgccgatcagcccgatgacaaaaaatgcagcaaaccaccagtaataggttttcgcgaactcaaatcctaaatgtcttgataaaatgatgacaaacattacatagggaacacttgaaaatatgatgcgaagaatattcaaactgccgctcctctcagatgttacgcttaaaagatgaacttttttccattatttcatagtaattgatttttcttgaaaagtaaacacaaaaagaatcggcccgcttatgacaggcccattctttatttgccggcagatttcttttcaatcgctataataaacggcgggtcgttttgctggttgagaaagccgtagctcagcacgcgggctttttcctgatcaagattgctgcagtattccagtaatgcacttttttccgtcttgccttcaggatgcccgtggtacacaacgagaacgatcagcccgttctccttcagcagttcaaggagctgttcgatcgcggaaatggttgagtgaccgtttgtcgtaatgcttttatcgccgcctggcagatagccgagattaaagacggcgcaagccacacgaccgtgcgcatcttcaggcagcgatgcctttatttgatcatggcttttatggtgaagcgtgacgcgcgggccgaagtcggcaccgagccgctccttcgttttagcgagtgcgtccgcttgaatatcaaaggcatggacatgtcctgtctcaccgacaaggccggccagaaaatatgtatcatgtccgttgcccatcgtcgcgtcaaccgtgatatcaccttcctgtgcggcggacttcagcaattctttactgaaagggaggatgtgcatcaaggtcatagggcggtctcctccccggtctttctgaagagctttccttgatagcttccccgtgtttccagctctttttgaatggcgcccagtacttcccacttattgacgctccacatcggcccgaccattaattcgatcggcccgtctcccgtaatgcggtgaacgatcatttccgggggaatgatttcgagctgatcacatacaagacttacatattcttcttgagaaaggaactccagctttcctttttcatattgcttcaccatcggtgtgccttttaataagtgaagcaggtgaattttaatgccttgcacatccaaatcagcgacggctttggccgtctccatcatcatgtccctgttttcaagcggaagcccgttaatgatatgggaacaaacgcggatgccgtgttttctcagtttattgacaccctcaacatagcagtcaaaatcatgggcgcggttgatcaggagtgcggtccgttcatgcacggtctgcagcccgagttcaacccacaaataggtccgctcattcagttctgccaaatattccacgacatcgtccggcaggcagtccggacgggtcgcgatagacatgccgacaacgccgtcaagcttgaggacggattcaaatttttcacgcagctcctctaccggggcatgcgtattcgtgaacgcctggaaatatgcgatatatttgccgtctttccacttttcgtgcatacggtttttgatatcgtgaaattgcgtgagtaagtcatcggcccggttgccggcaaaatcgccggagcccgccgcgctgcagaatgtgcagccgccgtgtgcaaccgtgccgtcccgattcgggcagtcaaaaccgccgtcaagcgcgactttaaacactttatgcccgaaatgctcccgcagatgataatttaatgtatggtaccgtttttccgtatttgaataaggaaaagggttattctcgttcaatattcaaaaagcctccctcacatcagatgcatcctaaaattgtagcatgaatgatggagcggaacaatgaaacaattatggaacggtcaaggcgtaatatctacctggtttttctgttgttgttttaatcgttttggagaaatatcactgaacaatgcaaaaataattcctaaaataagaattacactgcctactttgaatgtattattaaaactgtcacttattttttcattatataaatttgaaatttttttctggatagcgataacttccttcttttgagtattgaaacttttttgtaccttttctttatatggatccggggttatagaaagaatttcttcctcttttttgtttaattcagcaatactttttcttcgatcgaaacctttactgtctgaatgctttaagtgagttattatctcgttttttgcatttttatcaaaaacctgattgttttccacaattgttatggcttctttttttgcagaagctgtgtgatcatttatattcattgtaagcacagatgtaagtatggcaatgcctagcgcttgtccaactgtccgcatcatattaagaatgcctgaggcaatacctactttctcaggaggaataagccgtatccctgaactcattgccggtcctatcacaagccctaaagctaagccggtcaaacataacagaataactaccgttgttacagaactgtcgtatcgtatgtatccatataaatatgttgtgattgttaaaccgagcatacctagacccgaaagccaaatgcccccgagtttatcagatagctttccagaaagtacagaggtaaacatagatgatagagctaatgtagaaacaattaaccccgcttctaattcagtttttcccattaaattcgtgaggagtaaagtaataataagggtaccgcttgttaatccaaggccctgcataaagagggtgaaagaactgaaactaaacgtacgtatcttcagcatggataagggaatcatcgggtttttaattttagattcaataaagaaaaacaaacagaataataatacagagattacaaaaagagagataattaatggtgatgaccagcctaaatcagatacttttgcaaagccaaaggttaaacagaagagagctccggataaaataagaatccccatgtaatcaatttttttactcactgtttcatcataactctcagtaataaaaaatgctgctaaaaaaagagaaatcaggcctaaaggaatatttatgaagaagatagcttgccaattaaagttttcagttaataatcctccaagtacaggtcctaaagtagctgctaatcctgagaaagccccccagattccaatgatcaatccttttttattttgaggaacgatggccaaagcaataggcattgtaactggcacaatgaaagcagcagataatccctgaatcactctaattgtgataagcatttcaattgaagtgctcaaacaggcaataactgatgtcaaaataaaaagtgctaatccaaacataaaagctttttttcttccaaaatggtctgccagctttgatgcacctactaataaaactgcaaaagctaaagtataacctgtagccacccaagctacttgagaaaggttgctcgaaaagtaatccagcatcttaggtaatgcaatatttactatagtggtgtccattaccgaaatgaatgtacctaataataatgcagataacataattaattttttgaaattcaaaactacaacctccatcagatattaatctaaattaaaattcgatatatatctaaaaacatgataaatgcaatcttaagaggtgtcaatattattcataaattgttttttcatccacttatctcgaaatcatatttttataattcaacaattttgtaacttgaaataactcaataagagcttaaatggacctgtaaactagctgagatgattaaggatttctgaagagtatgacatgaggagaatacttagcatgaggtgaagcaagtctaataaatctaggactgctcatgataatgctcagtcaggtaagtgctaattagaaatgaatattctttgaaagtttccttttgattgataatattaaaaatgtaaaatgtctggcatgaagatagtacaacgttttcctttgtggaaaaagactttatggggtgtgaaaaagtgcggttaataataaatgacagtgtttcagaattctttgacaagatatcctctattctattcttaaaacacgaggaattcttcaaagattatacaaccaaattgggtttgaatttagataatgaatattttgtattattagatgatcttaaaagaataaaagagttagatagtgagtttttaaatttttattttggtagcttttgcgactacaaagatgttaggaatgcaaatattttttgtttagccacaacattttttaaaataccacaaatttacacgaaagatttttttgaaattattgattatttgtctgcagttacagaagaagagataagaaaaaatattttagagtctctaatttatttacaaggagatcttaaaaccgaaacatctacccaacagtatttaaatgatagggaaagtttatttgagctacttaataatctaaatataaagcccgaatacaagtggatcatatttaaggtaatgaaatctcctaaaacttatgtagatcaattttgcaataaattaatgttggtgaatggttatcttaacgaggcgatttataatttaattaaattcagagatgagtggatgaatcaattaaaaaacataaatatagattttccaaaaaagataatcagtacgttaaaaggtaaggaatacttatcttgtaattatattaatatatatccaacacttttaccttgcactgcaactattacgaaaagtgaagataacatttatgttggactgggttataaagttgataaaatatttgaaaatacattagagaaagcagagattaatcatatcattgattttttgaagcttttatcggataaaagtaagttcaagatattaatcttacttagtcataaaaaaatgtatgctaatgagattgctgaacagctaaatttaaccaacgcaacgatttcacatcatatgagaattttgacattgcaaggtttagttgagagtacgagaaatcaaaataaaacatactattatcttaattcttcaaaattcgattcacttttgaacggtttgttgaaaaaatttaaagctgttccagtcttagatggggatgagtaagttttatagttggtgttagtttcgggatgataattaaagctaataaaaacagatctaaaaaatttgatgaatcccgggtgttttacacaaaaaagataatttaatggtgaacaatttaaagcgaaccgaagatcttgtgggtgatgtggaaaaattatgatgtttttaataaaagaagaattaagttatcgttctaaaatgaaggatttttataaagacttcattctgtcttgattaagttttacatttaatcgtattttatgccatctctgtcttgtgaatgaattacctgatatttcttgtgagaattaatttggaataagaaatactattgatatgacattatcaataggaggactgtttaatggcaacaagacaatcagtagatgaacatctccaaagaagcgaacaggcgtatgaatttgcgaatgagcaatttatgaccgcttcaaaacaagagcattataatgataatgagtacagtgaagcgcaaatgatgcttgaaaacgcggtgaatgaattaaacaagctgtcattatctgcgaatgatcagcaaagagagcagctttaccgaatgagattgcagctgcaaaccttgcaaaacaacatgattttgcagcgtaattttgattactgatcgcgccgtttcaaatggttcagcaaacctgccggaatcccggcgggttttttttatttcttttaaaaaaagaattgacaataggcctgagtgtgtttattgtattacgtgtactacttgatgtaatacacataaaacactcaaaaaatgaaatcgacatataaatgttaagcatagggaaggggaactttcatgaaaaacaaaagatccgtaaaacaagatgtgcctcttattatcgccgcttcggttttggccagcagtctgtttgtcgttcttgtcgtcatcggttttcaatggcagaacatttaaagaaagagagcagctcgtaaaagaaagaagggaagtaaatgattcaaatcgatccgagaagctcaactccgatttatgagcagatcatacagcaattgaaagagctttgtttaaaagggatcatgaagccgggggataaacttccttctgtcagggaattggcaacgatcattatcgccaatccgaacacagtcagcaaagcgtacaaggagctcgaacgcgatggtgtcattgaaacgctgaggggaagaggaacgtatatatcggagaatgcaaaaacgacattggttgaagggaagatgacgatgataaaagagcaattgaaacagctcatcatcgatgcccattacgcgggagttgagctggagaagctgcaggaatggataaaggaaatcagcgctgatgtgaaaggaggaaaggatcatgattgaattgcggaatctctcaaaaacgatagacggtaaagaagtgctcaaggatatttcgctcaccatcggaaaaggggaaattttcgggctgctcgggcggaacggatcagggaaaacaacactgctccggctcattcagcagattctgctgccggatcaagggacggttttatttaatcaggtggaaataaagcgtcatccgaaagtcaaacagaacattatttatatgcctgttgaaaatcctttttatgacaagtatacatataaacagcttgttgcgattgtaagcagaatctatccgaattttgatgtgacttacgccaatgagctgatgaacaggtacggcattccggaaacgaagaaataccgtgaattatccacaggcctgaaaaaacagcttgcgctcgtccttgcctttgcttcacgcccggctcttatccttttggatgaaccgacggacggaattgacgccgtaacgcgtcatgacgtgctgcagcttatggtggatgaagtagctgaacgggaaacgagcattctgattacctcacaccgtttagaagatattgagcgaatgtgcaaccggatcgggtttttggaaggaaatcagctgacgaatgtgatggacttggatgatatgaaggaagagtacatgaaaatccaaatggcatttgaagaggacgtcgccttgaagatcagagaacaaaatataccgattctcgaccatgccggtgtgttttatacggtgctgattcaaaagaacgatgagaagaaaaagaactttctgcaagagctgcagccgaaagtatggaacgaacttcctgtgaacttagaagaagtcttcatcgcgaagtttggagggaaccggagatggtagacaggggattgctgtacagggaatgggtgcagaatcgaactgttcttgtgatggtcggcatttttttagcggcggtcaatccatttgaagtgttaaatacctatctggtttatcaaggctgtctggacacccacggagcatattgtaagttttatgtgaattctttggatagcggaatgctgaacttaaactgggcgcccgctgtgattttggcggtttgcttattcggactggaacgtacgaaaggtacgattgatgcgcttttcagtctgccttactcccgcgctcaggtgttccacactaaattttggctcggagcggcggtcattaccggcgctcaggtgatcggctacgggctggctgagctgctcattcttctgttaaagcctgagcgcgtatatttcttccaccattacagcgtcggagagattattgtgagtgttttggcttttacattggttgcgagcgcgggctgcttaacggggaatacgttcgcccagctgttaacggcgtttgccgtgtcgatagcgccttacctgattattacgttgccgctgacaaatgcggaagttatcttcagggtcggcatgcatgagctgatgccatcagtcaatgcttacctaaacgattcgtttcaatatctgattccgatcatgtatgttaatacggactgggtatctgccagcaagtatatattaatcattccggcagtgatgagcattgtattttatgccatcgggtacttttgctatgtcaggcagccggtggaacggaacggccgtttttttctctggagacagcttgaccggcccattcagattgtggtgatcatcatcgccgttctcggttttggcctggcggggtactcgacgggacatacgatgacagggtatgtggccgggatgctggtcggaggagcgatcggatttttggtcagttattttgtgatttataaaaaaacgaagcatgtgtaagagaggaggaccggaatgataccgcggggattgttgtacacagaatggaaaaaaaatcagtggttgtttttatgcagcggcattcttttaatggcggcaaacccttttatggtttataacaactactcaacatatcaagaatgtttgaataacccagctcttcaagattgtgaatttgttgtcaattatacgaatgggtcgcctctttccttcagctgggttgtgagtgtcatcattgctgtcttcttattaggcttggaacggacaaagggaacgatggatgctttgttaagcatgccttacagcagaggccaaatctttcagacgaaattctggctcggcgtggcagtcattgttgctcctcaggcgataggctatgaagcggcgtcattgctgatatctttgttgaaaccgagccatacgtacgattttgatcatttttcaatcggaatgattgtcatcagctttatggcttacgccttgttaatggcatccggcgcattaacgggacagatattcgcccagctgttaacggcgtttacagtaacggttctgccctttttactcatcggtctgccggccgcgaatttggaggtcgttttcgattttagtgtcggagatcaattttcttttatcagcagttatatcgaatcccgtctttttatatttataacccctattggatatgtgtttaacgactggatcagagaaagagatttgattttaatcattccgattgtgatgagccttgtcttttatctgatcggttacgtcagctttctgaaacatccgaatgaacggaacggcagattctttctttggagaaaattggaccggccggtgcagatcttggtgattgcgtttgccgttatgggtttcggcgttttcggatatggggtcacagacacgatgttcggctatttagccggcattatcttcggcgcggttatcgggtttttcatcagttattttacggtttacaggaagtcaaagcatatgtagatctgtttgagaatgaacagtttggaggaaagcaaggtgccgattagcggtttgctttataaagaatggaagcagcggcagacgctgctgctgcttacagcggggttcttatctatcttaggccctttggcaattataaatgagtattttcactataaggattgtttacgtgcacttcagctgtacccggggtcagtttgtacattcagcatcgattacatcaattatcggaatttgattgggcttcatttcattccgccggttgttatggggctttttctgataagagcaggccgggctgaaaggatgtttacactgagtcttccgtattcgagaagccggatatttcatacgaagtttttcttgggagcagccgtgttagccggctcacagtttgtttcttacggagtatccgacatattgttcctagcgcttaaacctgacgctgtccatcattttcaatcattcagcgcagggatgctggtcatcagcttgatgatttacgcattagtgacagctgccggcacgataacgggcaatttagcggcgcagctgatcacagcgttcacggtttccgtctttccgatcgtggttatgacgatttacctgttaaacgccgagttcctttttggcaggcaggctgtgccggatattgatttcccttggagcggatttctgatctatttcatgcctgccgcttacatccatacatcatggatgtattacatgaaacacgcattgttcatctccgcattaatgggattttgtttctatctattcggctatgtgaatttcctgaaaatgccgaatgaacgaagcggacattttatcctgagcaaacacattgaacgcatcattcaagtgctcgtcatgtcgctcagtatgctgggaagtgcgggggtatgcggatatgcttataaccgttcgtataccggctacatattcggcatgctcatcggtgcggttatcgggtttttcattaattattacttcatctataaaaaaacgaaacagatataagggggagtggtgtacgtgatagaggtacagcatatcgatcattcatttaaaatcggcaggaaaggcagagagagtgaggttccggtactgaaggatgtctctttgaccgttgaaaaaggggaaattgcctgtatcgtcgggcggagcggttccggaaaatcaacgcttctgaatttaatttcgggatacatagcgccgacaaagggccgtatcgtcattaacggcactgatgtgacgggtttcaatgaaaaagagtgggcgcagttccgcctcgggcatttcggctttatttttcaaagctttcagctcattccgagtctgacaacctatgaaaatgttgaaatgccgcttgccttaaaaggcgtcaaaccgtctgaacgcaagcagaaagtcgcagatatgctgaaacgggtcggacttgagaatcatgcgaatcattatccgaatgagctgtcaggcggccagcagcagcgtgtcagtatcgcaagagccctcattttaaatccgtcaattattttagccgatgagccgacgggaagcctcgattcagaaacggaacttgaggtgcttgcattaattcagcagctgaaccgggagcgcgggattacatttgtcatcattacgcatgacgatgaagtcgcttcgatcgcgcattcaaaattccagctgcatgacggtgtattaaaagggggcgttactgttgagatttaaggatcagattcactttatcagaagaaatatgaagaaaaaccggctgcgtgttttcatgacggtgctggcgacgacaatggcgtgcgcgtttttagtggtgctggcttccgtcggattcggcatccaaaaaacgattacagacattacgatgagccagcagattgttacggaaatcaatgtgctcggccaagaaaacggaaaagccgtgaagaaatcagacttggaaaagtataaaaatgtcaagtctgtcgttgagagaacacaagtgtatgaaccgaacaaagcgtcattgggaaaccgaacaaatgaagattcagccattgtgctgacaaacatgaaagatgaagtcaaagccaatatggagcttgatcagggaagagtcgcccgtacagagaatgaaatcgtggtcggctatgattttgcgaagaacctattgacgaaaaaagaggctgacgcttacgacaaagagttaaaggatcaccaaggcgacatgtcggaggtgaaaaaaccaaaaggctatacgaaagacctgcttaataaaacgatacagctgagcatctccaaaacaaacaaagacggagacgttgaaaaaacgaaaacgtacgacttcaaagtagtcggaattacaaaaaaaccgtcccaagattggatggaggatacaaatatttttgtgagtgatcaattcaagaaagacttctcgacattcttggatctgaagaatggaaatgcggaaaaaagcatcaatgtgtatgcggacaaattcgatcatgtcgatcagcttacccatgacctcacggatgacggcttttatgtcagatctgtcacaaccgagctgaagggcgtcaacacctttttcctcgtctttaaaatcggtctgatctttgtcggctttatcgccgtcgtgatttcagccatcggtattttcaatacgatgacgatggcggtgacggaacgaacgcaggaaatcgggattatgaaagcgatcggcgcaagcccgtccatcatccgcagaatgttcctgatggaaagcgcctatatcgggatattaggttctgtcatcgggattatcatttcttacggagtgagttttgccgtcaatctggctgtgccggttatcttgaaagcggtagggggaaataccggagctgaagatcttcattataccttctcctacatcccgctcagcctcgttgtgatcgcagttgtcatttgtgcgggggtcgcggtgatttccggtatgaatccggcccgcaaagcgacaaaaaccaacgttctgaccgcattaagaagagaactgtaaaggaaaaaagccggctggacatcagccggtttttcctctatctatcagaaaagggcggataccatgtttcacattttgttaatagaagatgataacactttgtttcacgagatgaaggagagattaacaggctggtcatttgcggtgcacggaataaaggatttcagccgggtcatccgggagtttactgaaattaagcctgatttggtgatcattgatgtacagctgccgaaatttgacggctttcattggtgcagaatgatacgctcccaatcaaacgtgccgattctctttttgtcctcgcgcgatcatcccgcggatatggtcatgtcgatgcagctcggggcagatgattttattcagaagccttttcactttgatgtgttaatcgcgaaaatacaggcggtgttccgccgtgtgcaccaatacggcacagaaccggcgctgatgaaaagatggtgcggggcggtcattgacacagaaaccaacacggtcagccgtaaaaacggttcggtcgaactgaccaaaaacgaaatgctgatcttaaaactgctggctgagcagaaaaataaaatcgtcagccgggaagaactcatcagaagcctatggaatgatgagcgtttcgtcagtgataatacgctgacggtgaatgtcaaccggctgcggaaaaaactcgatcaattaggcatcgggaaaatgattgaaaccaaggtggggcagggatacatcgcaaaggaggaagacggtctttatgattaaatcatttctgctcgaaagaaaaagctggatcgcgatgtttcttttgcagcaggctgtgctcctttttgcggcatatattgatccgtctattccgtttttttcggtgctgtattttgtttacctgtcgcttcttgtgtttcttgtatttctcttgttccgctatcgtaaagagaccgcctattataaaagcttaagagagtgggacgccaatttagacatgtcttatcttaaagcgcctgacagtccgtttgagtctatcgttgaagaaagcattgaagggcagacagagcaattacgaaaaagctcacttgatcttcaggcggcgtcagagcatgaaaaggatgatctgatgtcatggattcacgaggtcaaaacaccgctgacagcgatgcatctcatgatcgagcgccttgatgaacagccgctgaaaccccctttgctgtatgaatggctgcggattcaccatctcctggaccagcagcttcatcagaaacgattgtcctttattgaaaatgatttatcattccagcgcattcagctcagaccgctcgttttcaaagaaattaaaaacctgcaatcatggtgcatacaaaaagggatcgggtttgacattcagcttgattcgccggacgttcacagtgacggaaaatggctttccttcatcatcaggcagctgttaagcaatgccgtcaaatacagtgaagcggatgacattaccgtaaaaagctatgaacaaaacggccgggtgcatgtcgatatcgaagaccgcggcatcggcatcgagcccaaagatcttccgcgcatttttgaaaaaggatttacctcgacgcgaatgaggcgagatcacgcgtcaacggggatgggcctgtatttggctcaaaaagccgcggctccgcttctcatccagatcagcgtgcgctctgagccggaaagcggcacggtttttaccttggtgtttccaaaacagaacgatgccgtcagcatgttcagcgtgtgacaaaagtgtcacatgcttttctcttttgttcgcttaatcaaacgaaaaaaacggcttctgtttttaaaataaagataaccaatgtaaaaggagaatcataacgtgatgattttagaagcaggcaatatccaaaaaagctacggaaacaagctgaataaacaagaggtgctgaaaggaattgatcttcagattcacaaaggggaattcgtcagcattatgggcccgtcaggatcagggaaaacgacccttttgaatgtgctttcctccattgataaagtgagcgcgggcaccattaaactgaacgagacggagattacatccatgaaagaaaaacagcttgccgaattcagaaaacggcatctcggctttatttttcaggattataatttattggacacgctgaccgtgaaggaaaacatactcctgccgttatccattacgaaaatgtctaagaaagaggcggacctgcgatttgccgagacggcagaggagcttgggatctatgatttgagacataagtatccgagtgaaatttccggcggacaaaaacagcggacgtctgccgcaagagctgttattcacgagccgggcattatttttgctgatgagccgaccggagcgctcgattcaaaggctgccacggatttattgaataaactcagccgcctgaatcaaaaacgccgcgccaccattgtgatggtgacgcatgatccggttgccgccagctattccggacgtgtggttttcattaaagacggccgtgtgtatacgcagctgaataaaggcggtcaggatagaccggacttttttcaggatattatgaaaacgcaaagtgtattgggcggggttcaggcatgagtattcatcatttgatcttccagaacctgaaaaagaatatgaaaaactattatctttacgtttttgcgctggtgttcagcgccgccctttatttcgcgtttgtcacgatgcaatacgatcctgcgcttgatgaaatgaaaagctccataaaaggagcggcggcaatccgggccgcctctgtactgcttgtggcgatcgtgtcggtatttcttttatatgccaacaccatttttattaaacggcgcggccgggaaatcggcttattccgattaatcgggatgacgaaaatgcacattttccgcatactcagcgcagaaaatttcattttgtatttcggatcgatttggatcggtattttcgccggcttttccctctcgaaattatgtatgatgatgctgtttcatacagtcggtgtgaaagcctctgtctcactgtttttttcaagcaaggcgctcgttcagacgttaattgtgttcggggcaatttacgtgctgattatgatgatgaattacttatttattaaacggcaaagcattttgtctttatttaaaaccgcgtcatcgtcagaaagcggcataagacggctttcttgggtgcagatgttgatcggcgttgtcggtattgcggccattatcgccggctatgccgtgtccgcggatttattcggaggcagttttacgagcatgaatgaactgttttcggccatggtgtttattctcggctcggtcattatcggaacctatctgttttataaaggttcggtcagctttctggcaaatctcatccggaaatcaaaaggcgggtatctgaatgtcagtgaagtgctgtctttgtcatccatcatgttccggatgaagtcaaacgccgtattgctgacgattattacgactctttcggcgctggcaatcggtttgctgtctttaagctatatctcgtactactccgcggaaaaatcggctgagcaaaatacagccgcggactttgcgtttgataaccaaaaggagactgactcttttaccgctttattgaagaaaaacggaattgaacacaaagtaaaaacaatcaagaccattcaagccggtgtcaatatgaagaacattataaacggcgacatgaaaagctttcaacaagacccgtccagcctggcgctgccgattataagcgagaaagatgcagaagggacggagctttctgacggagaagccgtgtttaccggatataatgatatgatgaaaagattcctcgacctgaaaacgtcgggttccattgatataaacggcaaaacggataaaataccgctggcgtataagggcttgaagaacgacttcctcctgtcatatacatttacaagcggagggttgccgaccgttatcgtcacgcagcaggtattcgaccggatcgagaaagatatcgacccgtccatccagggaaaatcaaatcggtttttcggcattacactcaaacgagaagaggacatccaaaaagctgatggtctgtttcaggcgcagcactattcagacggtgcgctttcacaatttgaaacggctgacacgcaaaagaaaaacatggggctgatcatgtttattgtcggctttttgggattaacctttttgatcacctcaggctgtatcctttattttaaacaaatgggcgagtgtgaggatgagaaggctgattatacgatattgcggaagctcggcttcacaacgggagatctgctgaaaggcatccgccggaagcaggcgtatcatttcgggattccgctcgttctcgggctgttccacagctattttgccgttcagtcaggatggtttttattcggaacggaagtgtggacgccgatgatcatcgtcatggcgctgtatacgctgctgtactccatcttcggcatgctgtcggtgctgtattataaaaaggtcattcaatccgccttgtaaaacaattgaggagcctccgcataagcggaggctttttttgtatgaatagaagaaagcgatttttaaaagaatagacatacgtcattttttcgcgcgggggagccttatgcagaagtattttcaattgaaatctgaaacaggggcctttcatcttttttccaaggaacacattttcacattgttgatcatcggattgctgggggcgggcgtgatcgtattccggaaaaagctcaaccagagccgtatgatccgctatgtactattcattctccttgccgtgtcgcagatcagctatcatatatggctgctttgtcatcatgcctggtcgctgaaaacagctctgccgctgcagctgagcgacctttccgtctatttggcgatgctgatggtcatgacaaaaagcaaaaagctattcgccttcctctattttgccggtttgggcagcgccgtacaggcgatggcaacacctgatttaggggcgtattctttcccgcattttcggtacatcgtgtttttcgtctcccacggctgtgtttttcttacctgtctattcatggccgcttcagaaaggtacaggccgtcggcgcgcgggctgtgggtgtcggtgctgatcgtaaatctgtacggggcgtgtgtcttttttattgatcgtgtgctgaatgcaaattatctatatttaatgaaaaaaccgaagaccgcttcgcttctgaatgttttcggaccttggccgtggtatcttctatcaatggaagcggcggtgatattgagcttcttcattctgtatattccgttttggctgctgaggaaaagagcatgaagccggcctgtttttgcgaatccaatcatttgtaattttttcaacattccggcattatttttttcagattctgatgttgaaaaaagacgtccgcggcgatagaatgaatgtgctatgataacgtgatcgatacggagccgcggcttgcggtttccgttttttcatggggttttttatagagagagggggatcggtatgccgcgcgctttgaagatattaatcatcggaatgtttatcaatgtgacgggcgcatcttttttgtggccgctgaatacgatctatattcataatcatttagggaaatcgctgactgttgcggggattgttctgatgctgaattccggggccagtgtggcggggaatttatgcggcggatttttgtttgataaaatcggcggattcaaatccattatgctgggcattatgatcacattggcaagtcttctcggactcgttctgtttcaccaatggcccgtttatatttggctgctcatcattgtcggcttcggttccggtatcgtgtttccggccagttacgccatggcgggagcggtatggaaagaaggcgggcggagagcttttaatgcgatttatgtagctcagaacgcaggtgtcgccgtgggctcggcactcggcgggatggttgcggcgtactcgtttacgtacgtgtttttagccaatgctttgctgtatgtgctgtttttccttatcgtatttttcgggtttcgaaatatcaaaaccggaaatgcgagccaggtttctgttctggactacgagcctgtcagcagcagaacgaaatttacggcgcttctcatattgagcggcgggtatgttctcgggtggattgcctattcgcagtggtccacaaccgttgcgtcacatactcaaagcatcggtatgccgctttcattatacagtgtgctctggaccgtaaacggaatattaattgtcgccggacagcctctcataggagctgttctgaaaaaatggtcaggcgcgttaaaaacgcagatggtcatcggcttttgtatttttatcgtttcgttcggcgtgcttcttagcgccaagcaatttccgatgtacctcaccgcaatggtgattttaaccgtcggagaaatgcttgtctggcctgccgttcctaccattgccaatcagcttgcgcctaaggggaaagaagggttttaccaaggattcgtcaacagtgcggcgacgggcggcagaatgatcgggccgctccttggcggcgtgctggttgatcagtacggcatgagcgtgctgctgttgatcctgatggtgcttcttgttgtcagcatcgcagcgacggtgctgtacgacaaacgcctgaaaaccgttaataaacaaaacgtccaagtgcgatgacgacataaaaaatcccgctgtttcggcgggatttttttgtttatacgaccggaagcacgttgacggcgtccttaacgtttaaatacgtctttaatgaagaaaagctggcatcaagctgattcattctcatggcgagggaaggcttgatcccggtgataatcagttctgtgccgattaatttaagcaggtggtgcaatttgaaaatctggtctgccgtctgttcgtttacctcggccaaacctgataagtctataattaagtaatcatctttagatgcggttaatatgtccgtcaaagttgtcacaattgaatcaaatcgttcttccgttaagtttcccactaacggcaaggcggagatgccgtttcggatcggaacaatcggtgttgacagcgtcgtgatttctgtgagggaatcctccaggagcttttcgtattctttctgctctgtaatgtctttttgaaaaccgacaaaatagagcttgtcttcaacatacagaggatcaatgttgagttcattccaaaacggggtgccgtcttttttgacatttttcagccgcaccgtgatcttttctttctggtttaagctctttcttattttcgcgacttgttgacggtcggtttctttgctttgcagaaatctgcagttctttcctaatatctcttcggaagcgtagcctgtcatatccataaatccctgatttgtatatatgatgggattgtcctcaagagaggggtctgtaatcaccacgccgatgcgtgcgtgatcaagcgcctttttgataagctccagctgctccagttttccggatacatttgagtcagccatgtaaaacccccttttggccgtaaagctgcacgcttttttcagccgttgtttctcccctttttaaatgaatctacagtaaccgtagcataacatatgttctgattcaagcagccgaagtttgcaatttgtcattcgggcttgtcctcatatacactgaatatataaggggaaggcacatcatcgctaagtaagtgactaggtcattgtcactgggtgaaaaatgaatctaatgcatcaagcttaccgatcatgtgttcacatataatggaagaaacaagctttttactttcctgctcaatcgccggtatgtagatatcgaaaatcatcgtattcgtaagggggctggatggcctgaagtcgctttactaaataagggctttaggaaggtgatgaagatgctgcatcaggtaataattgcttgtgtaattggaggcatcatgggggttctcggtcatgtgaaaaagagaggcaggctggagaaacccagaatgacaaagcggtttatctatctcggttttttggaagatggttttatcggaatggctgcttccatcttacttgtcttatccgctgaccccgattcaggaattcaactcgtcatcttatccataatcgcaggctacggcggagaagctgttctcaggagctttgattttgtcagagaacaaaacagtgattcggccgaagcaaaaccacaccagcaaaaaaatcctccatcaaaataatatccccgctcacgacccgttccgggtacattcccattgtatacaaacctgcttgcacttatgaacagaattctataaaatacaggtaagattacggtagcgataagaacagtgaagaggagcagtaagaagcagatttcgcactcagagaattgacggccggtgcaagtcaatcaagtctgtttccgaactcgcctcagagttgcagcggcaaaaccgctgacgcataactgcgttaaaagtatcaagtgagtgcggcttaaaaccgcgctaacgagggtggtaccgcgggaaacaaaaatctctcgtcccttttagggatgagggagttttttttagttttagaataatctgaatataatcttcctcatcccgtcaatacttggactacatacgccgtattcaatcagaaggaggtttttacgttgagttttcagcacgaaaaaatagaaaagaaatggcagaattactggttggatcataaaacgttcgccgtcagtgaagagaatgacaagccgaagttttacgcgcttgacatgtttccgtatccttcaggagccggccttcatgtcggacatccggaaggctatacggcaaccgatatcctttctcgcatgagacgcatgcaagggtacaatgtgcttcatccgatgggatgggacgcgttcgggcttcctgccgagcaatacgcgcttgacacggggaatgatccggctgagttcacaaaacaaaatatagataatttccgccgccagatccaatcactcggattttcttatgattgggatcgtgaaatcaatacgactgatccggactattacaagtggacgcagtggatcttcaccaagctgtacgaaaaagggctcgcatacgtagacgaagtgccggtcaactggtgcccggcgctcggaacggtgcttgcgaacgaagaagtcattgacggcaaaagcgagcggggcggccatccggttgaacgccgcccgatgagacaatggatgctgaaaatcaccgcttatgcagacaggcttcttgaagatttagaagaacttgactggccggaaagcattaaagacatgcagcgcaactggatcggacgctcagaaggcgcaaacgtgcatttcgcgatcgacggcactgatgacacgtttacggtgtttacgacaagaccggacacgctgttcggcgcggcttatgccgtactggctcctgagcatgagcttgtggaggccatcacgacgcctgaacaaaaagaagcggtagacgcttatgttaaagaagttcaggcgaaaagtgacctggaacggacggatcttgcgaaaacaaaaacgggcgtcttcacaggtgcatatgccgtaaaccctgcaaacggggaaaagctgccgatctggatagcggattatgtcctcgcctcttacggaacgggcgctgtaatggccgtgccggcgcatgacgaacgtgattttgaattcgccaaagtgttcagcctgcctgtcaaagaagtcgtaaaaggcggaaacacggaagaagaagcgtacacgggagacggagaacatgtcaattccggctttctgaacggactgaataaagcggaagcgattgaaaaaatgatcgcctggcttgaagaaacgaaaaacggtgagaaaaaagtgacataccgtctgcgtgattggctgttcagccgccagcgctattggggcgagccgattccggtcattcattgggaagacggcacgtcaacagccgttccggcggaagagctgccgctgattctgccgaaaaccgatgagatcaaaccgagcggaacaggtgaatcaccgcttgccaacattaaagagtgggtggaagtcactgatcctgaaacgggcagaaaaggcagaagagaaacgaacacgatgccgcaatgggcgggaagctgctggtatttcctccgctttatcgacccgaaaaatccggatcagctcgcttcacctgagaaactggataaatggctgcccgttgatatttacatcggaggagcggagcatgccgtgcttcaccttctgtacgctcgtttctggcataaattcctctatgatatcggtgtcgtgccgacgaaagaaccgttccaaaagctgtataaccaagggatgattctcggggaaaacaatgaaaaaatgagtaaatcccgcggaaacgtcgtcaatccggatgaaattgtggcgtctcacggagcagatacgcttcgcctgtacgaaatgtttatggggccgcttgacgcatctatcgcctggtctgaatcaggccttgacggagcgcgccgcttccttgaccgcgtatggcgtttgtttatcgaggaaaacggcgaactgacgggtaaagtgacagaaggcgcgggcgaaactcttgagcgcgtctatcatgaaacggtcatgaaagtgacagaaaacttcgaagcccttcgttttaacacgggcatttctcagctgatggtgttcattaatgaagcttacaaagcgaatgaactgccgagagaatatatcgaaggttttgtgaagctgctttctcctgttgcgccgcatttggcggaagaactgtgggaaaaactcggccacgaaggttcgattgcatacgaggcttggcctgcttatgacgaatcaaaactggtggacgatgaagtggaaatcgtcgtccagctgaacggaaaagtaaaagcgaaattaatggttccggctgatgctgataaagcagcgttagaacagctcgcacaagctgacgaaaaagtaaaagagcagcttgaaggaaaaacgatccgaaaaattattgccgtaccgggcaagcttgtcaatatcgtggcaaactgaccggacgaagcccctctcctacagagaggggcttttttatcaggcctctatcatagaaattgcaccgcgggctttggtatacttaacaccataaagatgaatgggagtgtcacacattgaaaataaatgaaatcagcacagccgcactggaagaaaaattaaaagcgggagaagagctgtatctgattgatgtcagagaagacgaagaagttgccgaaggaatgattccggaggccgttcatatccgcatgggggacatccctgagaagatggatgcgttagacaaggacaaggaatatgtatttatctgccgttccggaaaaagaagcatgaacgtttgtatgtatttacatgagcagggcttccgtacagttaatgttgaaggcggcatgctggagtgggaaggcgaaacaaagccgaagaaataacgctttgaagtgaaagaagaaaagggacgtgcgtctttttcttctttttttataaaaaaacgggaggcgaatcaggtgaaaccgatgatccgcgcgatgaaaacaaacgatatcaaacaggtccggcaagtcgcagaacgcagctggcatcatacgtatgaagggattattcccagacacattcaggatcagtttctcgaatccgcctatcaggatgagatgatggaacgccggctcttgcattctttattctttgtggcggaagaagaggggcgagtgctcggttttgcaaatgccaccccggttcaaaaagacggaaatgcggagctgaccgccatctatattgatccggattgccagggaagcgggataggcacggcacttcttaaagaatgcatcaggcagtccggcggggtaaaaaagctttatgtccatgcagaaaaagagaaccgcatcgccttatccttttatcaagcgaaagggtttcaaagggtatgtgaatttgaagaggattttaaaggacacaccttacagacggtcaaactggtgctgaacatataaaagcgtccggcccgcccgggaccggatcgcgaatgatcagtgataagccggaagccggtctttgtgcgcttcaaataagtcatcgcacaaagagatgatgtcattcatggaaagctcggcgctcgtatgcggatcaagcatggccgcttgatatacggcttccttttttagtgtaacggccgcttcgatggttaaaagctgtgtgttgatgtttgttctgttgagcgccgcgagctgctccggaagttcgccggaatagcacggcataatttggtttttaacggcggcgcacggcacttcaacgaccgctttcgccggcagattcggtatcagcccggtattcagcacattgccgccgaatgtgaacggacggcccgtctccatcgcttctataattctcgaaccgtattctttcgagcgttcatgcgtcaggttttggttgttgatgatcccgtctctcatcgtttcccagtttttgatttgttccgcgcatctcctcggatattcatcaagcggaatttggagttcatctatcagctccggataccggctttttataaaatacgggtgatattcggcattatgctcagatgattccgtcacgtagcagccgaatttatccatcagctcaaaccgcaccatgtccttatgtttcgtcttttgtttttcccgtgcccgtcttttaatttccggatataaatcaattccgtcttttttaatctccaaaagccaagccatatggttgatgccggcaatgcgttcttccgtaccttcgtgatccatgccgagtgagtcgaacagatctttggtacagacctggacgctgtggcacaggccgaccgttttgacatttgtatgtctgagcatcgctccggtcagagaggccatcggatttgtatagtttaacagccacgcatccgggcagacctcttccatgtcttttgcgatgtcaaataaaacggggatggtgcggagggaacggaaaatgccgcctattccgacggtatcggcaatcgtctggcggagaccgtaccgtttcgggatgtcaaagtcaatgaccgtcgcgggtttatagcctccgacctgaatggcgtttatcacatagccggcgtgtgtaagcgcctgttttcggtcatcgtaggagatgatggatatactcggattgtagcggtctctcatgttttccagcatgagctgagattctttcagccgtacagcgtcaatatcataaagcgcgaattcaaatccgtttaatgcttcagtcagtaaacagtcccccagtacattttttgcgaaaatcgtgctccccgctccgataaacgtaattttcttcaacagaaattcctcccttttcttctcagcctttgaccgccccggaggacagccctgagataaaatatttttgaagcgccaaaaacaatacgaccattggcagcatcgccataattgcggctgcggcgactaagtgaagattgttcgcgttttcgccgaagaaccccgccatggccacggtcaatgtctgcaccttttgatcttgtaaaaagaaaatcgcaaattggtaatcgttccagataaacacgcaggaaataatgcagaccgttgcggtaatcggtttcaacaaaggaaacacgattgtataaaaagtcctgatcaatcccgcgccgtccatcctggcggcttcctcaagttctttcggaatggaagagcggataaaccctgaatataagaaaacggtcagcggcatatatgcagccgtattaatgagaatggctgcggcatgcgtattgaccagccccgcatcagcgaccattttgtataaaggaaccatggaagtcaaaggcgggataatcatgatggaaatcaaaaggccgaagacgattttgttcagctttgtatttcttctagcgagcgggtatgcggcaagcgaacccatgaaaattagcaaggcggcggaaacggctgtaataatgatcgtgttcagaaaggattgcccgagagaggcacgctcccatgcttcacgaaaattctgaaatgaaaaggcggagggcagcgaccattttgaactgtagtctccttttgcttttaatgacgtggtcagcaaaatataaaaggggacaatatgaacgcacgagataacggcggccaacagcgtaaaaatccgcattcgggctgttttcatgacatttccgtctcctttcgcttgaaatacacgagagccgaaaagctgatgacaagaataatgacggacataaatacgccttgggcggcggcatatcccgcatcctgccgtttaaaatataaatcatacataaacgtcgacatcgattgagaggaattgcccggcccgcctgcggtcagagcgaaaatgacatcaaacagcttcagcccgccgatgatattgatgaccatgttgatggtgacagccggcatcaataatggcagggtgatggtgaaaaacggctgaagacctcccgcgccatccatttttgcggcttcataataatctttcggaatgctttgcagccccgccaaatatacaatcatcgcaatgcctgcgtattgatacgtgttaatcatgacgataatccacgggtttgccgcagggcttgccaaggcgttgacaggaccgattcccagtgcgcccagtacatcattcagcgcacccccgtcatatgagaaaataaaataccaaatgtatcccataatcagaggactgataatgacgggcaggtagacgatcgttcttgtgagcgccttcatttttaagctctgattcaaaagcagcgcatataaaagtccgagcatattctgaaaaaaagtgcttccgatgccgtaaagcaaagtgtttttcacaataagccacgtgtccggatctgtaaaaagccttttatattgagtgacccccacccattgatacgtctgtgagaagccgttccagtttgtgaatgtgataaaagcgcctttgacaaagggaaaaatcatgaaaataaaaaccgtggcaagagcgggaacgtacatccaccacagtgacgcgggttttaccggcttttgatgctgaaatccttgggtttctcttgcaagatcactcattctttttcagctccttgtgaatcagattgaagacggagccgcttatattccctgccgagtttcgccgaaacttccgcgggggttaagatatcggccgtcagctcctgcccggctgtccccatcacatcccacattccgttcggcaaataaaggcggtcaaaataaggctgcaccttaatatgctgatagcgcttatagtcatttgcgtagaaaatgtccgtttgcacattcactaatccggccggaagcgaggtcgcttcggcaattgatttcgcatgctcgggacgggccataaatgcgatgaactgtttcgcttcttcaagccgcggggaatccttgaatgccgccagcgtgtaacgttcgcctccgatccaaaccggcgcgtctcccttgtggacggccggggtcggtatgatgccgacttttaccttcggattgatttgggcgacgtcttggccgagggtgccgccctgcagcgtaaaggcgattttgttttgcgccatcagttcaatgagctgggaccgttttgccgtcacggcatctatattgagcaggttttccttttgcatctctttcagtttgtcagataaataggtgaagtgtgtccagcggaaggttccgtttaacagctgttttttgtaacggtgtgcgggatctgtgatgagaagcggtgcggcgaattgatcgtaatattgggcaaatgagcttttctcatagccggcaaaccagaagggggtgactgttccgccgcttttttctttaatctgtctcagtgccttcataaaatcatccattgtttccggcggtttgattctgtatttttccaacattgtgcggttgtaggccagtccgtcctttgcctgattcagagggaaggcgtatattctgcctttggcgtctttgagcatgctgtttaaattcggatcgagccgcttcgtccaagacatgccgctgaggtcggcggtatattctccgtagcggattttggcccagccgtgtgtgtcgaaaagatcgggcatgtcaccggctgccattctgaccctcatcatattttcgtagtcattgcctgggaaatgaacgtttacttgaatgtccgggtgttctttttggaatgaatcagccaactttctgaatacggcgcgttcgctgtctgaggatattgtggaatagactgtcaatgttttctgcttttctccggcgccgctctgttctgccgagcagccgggtagtatcatgcaagtaaaagaaagaaacaaagccagtaagcgtttcatcttttcctcctttaaatatgatataaacgctgggggacatgtcacctcctttcttgtgagccgcagctttgtctgacaatcaatgaagtggggagcgtcacggccagcgggacggttctgccgtttaaacggtcgagaagcaatttgacacccgtccggcccatctcttccgtgtatacttttaccgttgataacggcgtgctggcgtattctgcctcatcaattccgttgaagctgacaattgccgtatcgcgcgggacttgaaggccggcttcctgcaaggcttttaaagcgccgacagccatcgaatcacttgcgataaaaaaggcatcggggagacttccgcctttgatggcttcattcatcagccggaacccttcgtgcatgctgtattcgccgatcagtacatgctccggcccggcgccggccatttgtaagaaagcggtcaaacgcttatcctcaatcgttttattgctgtttacaccgtctatgacggtatgctcccgctcccggccgccgatataaccgagccgctgataaccgagcgacagaagatgttcgatcgccttttgcgctgcggcataaaaatccacgctgacggaatcgtagcgggcgggatcgggggtgccgttaacaaataccgcgtgcctgaaagcggcgctgatattcgtaagcgcctcgtcttgcaggctgccgattacgatcacgccgtccagatcgtgaaacatatgctcttgaaaagacccgagatggatagaagatgtgataaaaactttttgccgaaagcattcttcctcaatgccttttcggatcgctgaaaaataaggatcctgccgttcttcttccggtgacaggcagctgacaatgccgatcaggggggctgaatcgctgcggctgcggttcttccgtttttttgccgacggctgatagcccagctcatcggcgatcctcagaactttttctcttgtttcatcagtcacggccaaagagtcatccttattcaaaattctcgatactgtcgcgctggatacagatgcctgtaaggcaatatctttgagacggaccatttcgcatctcctttttactaaatatttactaaacagaaatgacctggttattgttaaaatgatattatcatatgttagtaagcgttttcaacacctatttttggttacttttagtaaaaatcagtaaaaaagaaaatctgtttttctctatcatatttcaattgaaccggaataaattgatagagaaaggagagggtgatgtgctgaagatagctgtttttgatgaggagcatgaaaaggatctgcagactgaagtcaatacatttttaaaggggatttctgatgaacagctcgttgatattaaatatacggtagcggcggcctgtgatcctgaaggtgagcagctttattgtttttccgctctcattttataccgaaaataaaaaagcccggatgaaataccgggcttttttatgcattatgcttttttgacgcggggacttctcggtttttggtatttctccgcttgtttgattccttttctttcgctcgctaatgacttgtacagagacacgatcatcagaaggatcacgactgaaaacggaaccgcggcgagaatggccgtgttttgcagtgcggccagaccgccggaatataataatacagctgccacggcggactggatgacgccccagatgattttcacccggtttgacgggtccaaagagccgtaagacgtttgcattccaagcacaaatgtcgctgaatccgctgatgtaataaaaaatacagcaatcagaataagcgttaatacggatgtcaccattgtcagcggatagtggctgagtgcgccgaacagcatcgtatccgttgacattcccgcgacattgaatacgcctttctgctgaagatccatcgcggatacaccgaaaatcgcaaaccataagaaagccaatatacaaggtgtcaccaacaccccgattaaaaattcccggatcgtccggccccttgatacacgggcgataaaaatgccgacaaacggcgaccaggatatccaccaggcccaatagaaaatggtccagctgttaatccattcgcgtttttggggatcattcggagacaagcgaaagctcatctgcacgatattttggatgtattggccgatagaatcggtaaatgagttcataatcagcactgtcgggcctgcaatgagcataaagatcattaaaatacccgcgagcgccatgttggtattgcttaagtatttaatccctttgccgattccgctccacgcagaaatcaaaaataacacggtcacgacagcgatcaggatcagctgaatggaaaatgttttcggaatgccgaataaataatgcagaccgccgttgatctgagtcgctccgagccctaagcttgtcgccacaccgacaacggtcgcaaacaccgcgatacagtcaattgctttgccgatcgggccgtttactttatcgcccaaaagcggtgtcagtgtgctgctgatcaaaccgggcgcgtcttttctgaattgaaaataagcgatacataaagcgacgaccgcatagatggcccaagcgtgcagcccccagtggaaaaacgtgtaccggagcgcatcacgaaatgcttggggtgtttctgtttcacctgagggagagctgatggcgtaatgactgatcggttccgcagccccgtaaaataccaaaccgattcccatgcccgcgctgaaaagcatggcaaaccatgataataagccgaattccggtttttccccgggttttccgagttttattgtgccgatcggactcacaatgagaaagagacagaaaccgacaaatatagaaacgaccagcagataataccagccgaaagaatccgtaataaatttttgtgccgtatcagtgacttgctgcaggctgtcaggagaaatggccccccataaaaccgcagctgctgtgatgacaatcacaatccaaaaaacactggagatgttcttcttcaaacgttctcaccctctgactatttttttcaatacgccatttttttagtatggtcgcacgattgcagatcattcctttcttcctgttccctcaatcaggtgaaacaaaacgcagaaaactgtatcatgtttttggtcaattatcaacggggacgctcaggtaaatgcgctttaaaccatttacagcgagcgtgagaaacgtcctgcattcaaaccggcgagacgccccgtgacaaaggctgaagtgatattgtagcccccggtataaccgtgaatgtcgagtatttctccgcaaaaatataagccttccatttttttagacgccatttgtttcggctcaatctcttttacggaaacacctccgcctgtgacaaacgctttgtccaaagaaagcgttccgtcagcggcaaccgtaaattgtttgcagtctttgacaaaagccctgaattgatccttcggcagttccgtaaagcttgtctgcggatcaagaccgttccgttccagaagaaaaagcagataccgttcctgcatccacggcttcagtgcgtttttgagcgcttttttcggtgcgtctttcagttccttgtgcatcttttgaaataactcttcctcgttgatgccgggaaacagatcgatgcgtaatttgacatcgggctgctttttcagttctttgacgacaaactggctgcagcggagaatggcggggcctgacaagccgaaatgggtaaacagcatgtccatcacgtgtgtgacaataggtttgccttttttattcaggacgctgacggccgcgtttctaagggacagcccctgaagtgttttttgtttaataaacggttctgacgacgtaaccggcacttccgtcggaaagagttcggtcacggtatgaccggccgcttccgcccatgcatagccgtctccggtgctgccggtatgcgggactgattttccgccgaccgcgataatgacggcgtctgcgttaatgtgttcgtcattgtttgtcgtaatgcccgctgtcctgccgttctcgtaccgcacctctttgattttttcatttgtgcggatggtgacattcagttgttttaatcggttcaaaagcgcatcgacaacgctttgcgctttgtccgtcaccgggaacatgcgcccgtggtcttcttctttcagctgaatgccgagtttttcaaaaaaggcgatgatatcttcattattaaattcggaaaacgcgctgtataaaaagcggccgttgccggggatgtgtttaatgatttcttcaacggggaggcggttggtcacgttgcagcgcccgccgccggaaatcgccagcttccgtcccagcttgtttcctttatcgattaataatacgtccgccccttcttcgcctgccgcaatcgcagccattaaaccggacgggccgccgccgattacaattacgtcataatgtttcatatttcatcaacaactttctttttcacgtataataggcggaaatgtccgcttcctgctattatagcgaaagaaggggattccttaaacgtattttgtttttaagagctttcccaaaaagtttcccgctgtaattattaccgtctaattgcccagttgtgttaaaatagaaaagttgaatcttcgtagaaaatggtgatgaggaaacatgtcaagcaaattgttaaggggcacgttcgtgctgacgctcggcacctatatatcgcggattttagggatgatttatctgatcccgttcggagcgatggtcggagcgacgggcggagctttgtttcaatacggatataatcaatatacactgtttttaaacattgccacgatgggatttcccgccgcggtttcaaaatttgtctcgaaatataactccaaaggagactatgagacgagcaggcggatgctgagagcgggaatgtcggttatgctcgtaaccgggatgatcgctttttcaattctttatatttcggcgccgttttttgcggaaacatctctcggcggcacgagtaacaacggacttacgattgaccacgtcgtttatgtcatccggatggtcagtctggcacttttggtcgtgccgattatgagccttgtgcgcggttttttccaaggtcatcagatgatggggcccacagccgtttcacaggttgtggagcagcttgcccggatcatctttttattgggcgcaacgtatttgattttaagagtgatcaacggcggccttgtcatcgcagtcggatacgcgactttcgcggcgctgatcggatcattcggagggcttgtcgtcctttatatttactggaataagcggaagggcgatcttctggcgatgaagccgaatctcgtcccgtctgcgaacttaagttataaaaaaatgttcattgagcttttcagttatgccgctccttacgtatttgtcggactggcgattcctttgtattcatatatcgatacgaatacgtttaataaagcgatgattgcggcgggccataaggatatcagccaggacatgcttgcgattgtcaccctttatgtgccgaagcttgtgatgatcccggtttctctggcgaccgctttcggtctgacgctgattccgacgattactgaatcgtttacgagcaggaattataagcttttgaatcagcagattaaccagacgatgcaaattattctgtttttggttattcccgccgttgtcgggatgtccgtgttatcgggtccggcctatacgttcttctacggctctgaaagtcttcgcccggatatcggacaggatatattgttctggtacgcgcctgtcgcgattctgttttctctgtttaccgtaaacgccgcgatcctgcaagggattaataagcagaaatttgctgtcgtgagccttttcatcggcgtcattataaaagtggtgctgaacgtgccgctgatcaagctgtttcagggagacggggccatcttggcaacggcgctcggttatatcgcttctcttctgtacggttttatcatgattaagcgccatgcgggctattcgtatacggtacttataaaacgggtcattttaatcgcagtcctgtccgtcgtgatgggagtcgcggtcaagctgactcaatggctgctcagtttctttgtaacataccaaagcggccaggtgcatgcggcgattgtcgtctttgtctgcgccgctgtcggcggtgcggtgtacatgtttgccgcgtaccgaatcggatttttacagaaaatgtttggaaaccgtctgccccgcgttttgaggagaggcaggcattccgcccattgagaaataatgaatagtccgcttatcgcgggcttttctttttaaaggagaggatcaggatgagacttgataagctgcttgccaacagcggattcggctcaagaaaagatgtgaaaaaaatcgtcaaggccggggctgtcatgattgacggagagccggcgaaagatgtgaaaacccatgtcgatccggaaaaacaggacatcacggtatacggagagccggcagactatcgtgaatttatttatgtcatgatgaataagccgcaaggagtgctgtccgctacagaagacagccgccagcaaacggtggttgatctgctgacgcctgaagaacagcgatttgaaccgtttccggcgggacgtcttgataaggatacggaaggctttttgcttctcaccaatgacgggcagctcgctcatcgcctgctttctccgaaaaagcatgtgcctaaaacatatgaggtccggttaaattcacctctgtcaccggaagacatcgttcatctggaaagaggcgtcgtcattgaaggaggctataagacgaagccggcagccgttgaaatcattacagaaagcccggatgaaacggtgattcacttgaccattacagaaggcaaatatcaccaggtgaagctgatggcaaaggctgtcggaaatgaagtggcttatttgaagcggctttcgatgggggctgtttctcttgacccggatcttaaaccgggagaattccgcgagctgactgaagaggagctcgaaacgctgagaggcgctgaagtgtaatcgatatcagaaaagcccaaaacagatttgttttgggctttttatatagaggaacaaaaaacaaggcaaagacgctgctttgccttgcagcatgtcaggccgaaaaggaccttatgtaattgttcgcttaagatgtaattttcactttttttcgtgttgtctcccacttgcctcggctaggactatgaacaagatcattgtatgctaacacatttaagtctcgctgaatggttctaggtgtaatgccgaattcatcaaccagttcctgtgttgtcacaaggcctttttcctggatgaacatgtaaactgatttaatccgagtcagcatacgatttgttgaaggtttcaaaaaaccactccctatcataagatcggatggacttgatataccacaactttcgactctaaaacttcgtacgaataagcaacaaaggatgatattctgttttttttctcttttaactgcctccattatacacgatatggacgacatgaatctaggaataagcgcagataattttttccaaatgggtgcagccttggtgcattactatgtccggcccgcttttaatattatggaaactgaaactttttttatacatgtccgtatgaaagcgggggagtgagaagtttgggagaattattgaatgcaaacattgtctgcgccggttatgctgacaggccgaaggtgatttctgatgtatctctgtcagtcaacgctggtgaaattgccggtttaatcggagcgaacggcgcggggaaaagtacagtgataaaggcggttctcgggctgtcccgggatattgaaggcggtattgagtggcatgattcgtcttatgcttacataccggagcgtccgagtttttacgatgaactgacgctttgggagcacctcgagctgaccggatcattgcggggtatagaaggggaagagtgccgtgagcgggcagggcggctgcttgaagagttttcgctgacgtctgtaaaacatgatttgccttccggtttttcaaaagggatgcagcaaaagctgatgctcatacaggcatttttggcgaagccggatatttacatcattgatgagccttttatcggacttgatccgatctcaacgaagctgtttaccgacatgctgattgctgagaaagaaaggggcgcgggaattttgatgtgcacgcatgttctggatacggcggaaaaaatctgcgaccggttttatttgctggatcagggcgctctgcttcttcaaggcacgttagaggagcttcaggaaaaaacggggagccgttcactgctggattgcttttattcagcggttcggagcagtcagcgatgaccgggcgggctttgttttttcaaaggctgtttcattattggcggtatcaatggaaggtgtttcagacggtcattgattggacggtcgcgctgtatatcgttcttcccgctgccgcatttgccgtttatcaatatgctgaatggctgaacggcagggggcttcttaatggagcggcaggagtattaggatggggctggctgtatgtattcagtgccttgctgttgtgcacgggttttattcatacctttttgctggaagcggatcacgtgtttttggtgcatgcaaaacatctgatgcaaaagctgaaacggtacgcgcttttgtattcgatgttcctttcccttatcaaatggggtgcgcttgccgtattgttatttcccttatggcgccagtacggtgactgtaccttaccggcatattcaggtatgttttgctgtctgttcggcttccataccgcgatattagcggtgcaccggcacagaaaaaacagcaggcggacattcgggaatcaggcggcgggatggctgaaagtgatggttctgacggcgggtgcgttttttatgatcacctttgccgccgaatggtattggctttggccggcgggatgtatattgttcatctgttccgcttttttgacttggaaagggacggagacattatcagcctttgaggaagaagtgcttgaggagaacaggcggaagctttcactcgccgcctcagttttgatgctcagccatgatgtgcagctcccgaatggtaaaaataaagggcggagcaagccgtttttatatcccggctcaaagcacatctttacaaaacggtcggcgtatacggcgtggaaagaattgttttttaaagtgctgatccgaaacggcgggtatctccggcagctttaccttttaaccgcggcttttacggctcttattctcgttcttccgctcttagtgaagccggcagtccttattttatttgcgatcgtcagccgctatgccgcgtcacttttatttgaccggatcacggataaaccggttttaagcggtatcaagagagacagtgatgactatttccgggcgcgaaacaatgcattaaccgtcattcaaatcatctgttccgcctggtgtctcattgccgcgattctttccgttctttatatgtaaaaatccctttccgaaaaggaaagggatttttcttaatgtccgttcaaaataaaaagctgaataaaaaacagcacggcgaagatgaggactagaggatggatttcgcgccattttttcttagctgctttaacaagcggatatgaaatgaagccgagtgcgattccggttgaaatactggacgttaaaggcatcgccaaaatgacgagaaaggccgggaacgcttcatcaagctcattccagcggatattcgacacagcacccatcatcaggctgccgacaataatcagagccggtgacgtaatcgcggacacttccgataagacgctgacaagcgggctgaaaaacatggaaacggcaaacataacggcaatcgtcagcgccgtcagacctgttcttccgccggcggccacacctgctgaagattcaacgaacgcggtcgtcgggctggtgccgaagatgcttccgaccgtcgtagccgtcgaatcagccaacagcgctcttctggcattcggcagctgattgtttttgatcaatcccgcctgttcggcgacaccgatcatggtgccggttgtgtcaaaaatcgtaacgagaagaaaagaaaacacaacggcgtacagaccgtgatgcacgacatccccgagggcaccgaacggatttgtgatcaaaagaccctccggcaggcgcgggaatgaaatgaaccctttcgcaaaatggatctgtccggtcaaaaaggcaatgacggcggtcagcgccattccgatgaacagagcgccgtttacattcagcaccatcagcacgatactgatgataagtccgataagcgttaaaatgacggcgggcgaatgaagatcgccgagtgcgaccagattggatttatcagccgtgatgattccggattggcgtaagccgataaaagcgataaataagccgatgccggtcgtaattccgtattttaaattgtccggaatcgcttctataagttgttttcttaaaggcgttaacgataaaataataaagatgactcccgcgataaaaacggcgctgaaagccgtctgatacgtaatgccgctgcctgtgccgacaacgtgaaaggcgagatacgcgtttaagcccatgccgggggcaatggcgatcggaaaattcgcagcgagagccatccataaagttccgacaatggaagcgataatcgtcgcggtgaacacctggtcaaacggaattcccgcattggaaaggatcaccggattgacgacaatgatatacaccattgtgaaaaaggtggtcaatcccgcggtaatttctctttttattgtcgtttgatgcttgtcgagatgaaacataagtacctccaatgacgaacattttttcaaaacatcatctatattattcgttttatcgacattttgcaagtctttatcaagaaaggggatttgtgatgaactgggaagttgaagtcatcagaaacaaagaagatctgatccgtgacacgcagaagtttttgcagatcaacagcgtaatggacgaatcaacagccggtcccggccggccgtttggagaaggcgtcaatgccagcctggcgtcactgctggaattcggtaaaaaagaaggcttcaccgtaaagaatcttgacggctatgcgggccatattgaatggggaacgggtgacgaaatcgtcggtgttttgtgccacgtcgatgtcgttccgcccggagacggctggacgagcgatccgttttcagccgatatcagggacggccggatatatgccagaggcgccattgatgataaagggccgacaatggcggcgttttatgcgctgaaaatcgtcaaagacatgcagcttcctttatccaaacgcgtgagaatcatcatcggtacggatgaagaaagtgattggagatgcgtggatcactacttcaaacacgaaaaaatgcctgacatcggctttgctcctgacgcagattttccgatcattaacgcggaaaaaggaattatagatgcgtcactgcgcattgtaaaaaacgcttctgacaaagacgcaaaaaacgtgcttctgtcattccgttcaggactgcgcttgaacatggtgccggatgcggctgaagcggttattgaagggaacggtattgatgccgtgcacgcatatttcagcaaatggcttgagcagtcaaaaacacaaggtgaagcagtttcggaaaatggaaaactgacgcttcgggtatacgggaaatcatgccacgcgatggaaccggataatggtatcaatgccggcttaaagcttgctgaatgccttaacggaacagagctggatggagccggaaagcactttgtcaaaaccgtcagtgactattttttaaatgatacacgaggcaaaaagctgaaaattgattgcagggatgacatcagcggagagcttacattgaatgtcggcacctttacatacagaaagggtgaggatggagaactcggcatcaacatccgttatcccgtcacttcagacagcaaagtcatccgtgatgcttttacgtctgctgaagaattccggcttgaagaatttaaagacagcaaaccgcaccacgtttctgccgatcatccgctagtaaagacgcttcaaaaggtttacgaaggacagacgggaaagaaagcggatctgatttcaatcggcggaggaacgtatgcgagatccctttcggcgggcgtcgcgttcggtccgctgttccccggccggcctgacagcgcgcatcaaaaggatgagtacattgaaatcgatgaccttctcaggtcaacggctttatatgccgaagccatttatgaacttgccaagtgataataaaaagggacgccgaaagcggcatccctttttatcattcaaatgaccataaatccgtggataaataacgttctcccgtatcggccgtcatacagatgacgatctgttcgggagggaggcgtttggcggtttcaatggcggcgaagcaggcggcgcctgaagacgggccgacgagtatgccttcttcccgggccagacgacgtgttgtcgtatacgcatcttcatcagatattttcatgatttcatcgtaaacgtcctgattcagtatgccgggaataaatccggggcttgtcccgacaagcttatgagcgccgggttttccgccagacaggacgggagatcccgcaggctcggcgacatgaacaatcatatccgggaaaagctctttcagcgtttctccggttccggtaatggtcccgcccgttcccgccgttgccacaaaagcaccgagcggtctgttgagctgctgaacggcctgatagatttcaatggcggtcgtttttcggtgggcatctggatttgcgccgttatcgaattgcatcgggataaaacttcccggaatctgttcggcgagttctttcgcttttttgatgctgccgggcattctttccgcccccggtgttaacacaacctccgcgccgtacgctttcaggaggttgatgcgttctttcgtcatcgtgtcaggcatgacgaggattgccttgtagccgcgcgccgccgcgttcatcgccaggccgatgcctgtgttgccgcttgtcggttcgatgatgacagagccgggttttaaatgcccgctgttttccgcttcaatgatcatattgtaagccgctctgtctttgacactgccgctcgggttaaacgattctaattttaaatagacctgtgctgcatgttctggctgaaggcgattgagctttacgatcggtgtgccgccgatcagctccgccgtgctgtttacgattttcaaggccggctcattcctttctgtataaaacgttcggtacataatatcctatcataatgagcggacagggttctcctctccgcttatccgttttataataacaccataaccaaagagggggagatcctcgtatgaaagcttcattgccgcattattttatcggcattccgattccggctgacattgctgaaccgatttgggaagcagccaaaaaggagccggcgttatcattcaaaaaatgggtgcacccgcatgactatcatattacgctcatttttctcggagccgcggatgaagaacggcttgcgaaattatcgtctctgctcgcagatgctgcgtcggcagcgcagccgtttaccgtacagtttcagcatctggatattttcggcgaccgcagacagccgagagtgcttcaccttgagcccgaacggaatgaactgctctttgatttgcgggaaaaaacaaaacaggctgttttgaaagccggttttcaagtggaaaaacggccgtatcaccctcatatgacgatggcgcggaagtgggcgggagaccggccgttttctgacgatgtgccgtttgaaagcggcagggtgcaaagtgccgtcagcaggttttccctgtttcagacccatcttgaccggtcgcctaaatacgaagaaatcgcacagtttcaattgacataaacaaatattcggagtggagaaatcacatggcacagatcatcaaaattcacgactgcatatccagatatgaacttgatccataccattatatgaaccagtttatccggctgaagaaagaacgctgggaggcgcttcttgaagcgtttgaccggataacggaagaaacggaaacggctgccggcggggaaaccgatcaagcgccggccaggaaaaaattttccttaaaaaagagaaaagaagaaaatacggccgatataaatgaaaagaggcaccaatggtttgatgaaccggagggagaagaggcgctgttcgggaatcttccgtctcaaaagtctgagctcgcgccttttttcaaagatcagctgtatgactttcaattaaaatgggcgagctccacgctttctcaaaagtctgagctttcgcaggcggtcaaaagggacaggatgttaaaaatgctggctcaaaaactgcccgattcctattttgtgatgtatcatccggttctgcaaattcagcaggcgtccgtcgaactgagcattatcatcatctcgccgctggagattttctgcgccgcttttatggaagcggaagaggacagtgtatatatcggatcaaaacaccgtttttgggaagaaagaggctccggcagcacgcgccaagtattgaatccgtctctcagcctgcaccggacgggctcggtcgtttcgcaaatcgtaaaagaaaagcaggccgacattcccgtgcggaagcttttgctcagcagaacgtcttatattgattacccggagccgccgtacgggctggaaatagctgataaacggactgccgcagggtggctggaaaagcagcagaaaaatacggcgccgatcaagcaccatcagctgaaggcggcgaaggctcttttgtcttacggcttgagcgattcaagccggagacaggaatggcttgattaaagcggacgtttgccggctgtctcttcatctatgaagcaggtgaaaacaaacgatgagtcaatggttttttattattaatccggtctcaggaggcgggcggggccggcgtgtctggaaatcagttcaaaaagagctgaccaggcgcggggtcagccaccgctcttttttgaccgggcatcccggacatgcggaggtgctggcaagacagatttcaatgatgcaggatcataagcttaagcggctgttcgtcatcggcggtgacgggacgatgcatgaagtcattaacggactgaaaggaacggatcagattgagctgacctttgtgcccgcaggttcgtacaatgacttttccaaagggctcggtattaagaagtcggcgctcctccaagaaatcaaaagtctgcaccgcccgcttacacggaaattttttgcgggaaacatcaacttttttcatgacaaagcgcaatcactctattttattaaccacctgtctgtcggcttcgatgcctcagttttgaaggcagccgcgaattttccgttttcgcgcgttcttcggtttttgcgtctcggctttgtgatttacccgctcgcgcatttacatacggcctcggggtttcagccgttcagatttgtttgcacggcagacggccagaagcgtgaattccgcaatgtctggtttgtcattgcggctaatcacccttattacggaggcggcatgaaagcggcgccttcagcaaatccccgtcaaaactattttgatattgtcattgcagaaaacctgtcctttttttcgctgtatcgttttttatgggcgatgagcttcggccggcatatcaaaatggacggagtgacgatgataaaggggaaggaattcgtttttgaaacagatgggaaaattccgtttcacgctgacggcgagctgatcggaacgacgccgtttcggcttatgccgggcggtgcgccattgaaaataaaaacataataaacaaatgaaacccgtcaattgtttcacggcaacagagcggttcgcggcataaatcttcagaattcacaggtgttcttgctagttttgcttgacgaagtttgtgctgtagcgctaaaatttataggacggctattgattagcatatgagactctcaatagctgtcttttttattctcatgaaattgtttatgacaggccgctccgccaatagagaaaggctggaggcctattctaaaatattttaagaaatgatgggttgaacattgatatgaactggttgggacaattactaggtagcgattgggagatcttccccgccggaggagctacaggagatgcatattatgcgaaacataacggccaacagctttttttaaaacgtaatagctcgccctttttagccgtgttatccgccgaaggcattgttccgaagctggtttggacaaaacggatggaaaacggagacgtcattacggctcagcattggatggcgggcagggagctgaaggcaaaggatatgagcggacgcccggtggctgagctgctccgcaaaatccacacatcaaaagctttgctcgacatgctgaaaagattgggaaaagaaccgcttgatccgggcgcccttttgtcgcagctgaagcaggccgtctttgccgtgcggcaattttcgccgcttattcaggaaggccttgcttatttggaagctcatgtggatcaggtgcaattcggtgaaaaagtcgtttgccattgtgatgtgaatcataataactggcttctgtctgaagacaaccagctgtatttaatagattgggacggcgccatgatagccgatccggccatggatctcggccctttattgtatcattacgtcgaagagccagcgtgggacagctggcttgggatgtacggcatgaagctcacggaagggcttcggctgcggatggcgtggtacatgttatcggagaccatcaccttcatcgcctggcacaaatcaaaaggaaacgacaaagcgtatcatgatgccatggaagagcttcatgccctgatgaagcggattgtcaagtagtcaggagtacgaatccatctgctccacccattgggacaaatggttttggtgctcctgaatatgcgtgtcgatggaatcggccgtgatgccggactggctgtagcggtagacatcctcgagcacgttttttatatttgaatcaagcccggtgttggccatcagtgatttgatgacgcgctccagctgttcatactcggcaaccgtgccgcagcaatccaattgatggtcggccaatatgtcctttaataaccggacctgatgttcgcttgttaagcccatgattcatatacacatcctttctgtgtcatacattgtgcaaagcggtgcggttttatgcatcacatgagtgttccggaccggggagcctctttttttatgcggccggcgcctttaaaaggcgcttgcggctctttatgtttcatggtatgttgttactcgaaattatagatagaggtgtcaatcatatgagaatgcgccataaaccttgggcgaatgattttctggcagaaaacgctgacatcgccatcagtgatccggcccagtataaagggcggtggaatacggtctttggcaatgacaacccgatccatattgaagtcggtacgggaaaagggcagttcatttcaggaatggccaagcagaatccggatatcaactatatcggaattgagctgtttaaaagcgtcatcgtcactgccgtccaaaaagtaaaggacagcggggctcataatgtccgtttgttaaatatagacgcggaaacactgaatgacgtatttgaacggggagaaatcaagcgcgtttatttaaacttttctgacccgtggccgaaaaaccgtcacgaaaagcgccgtttaacatttaaaacgttcttgaaaaaatacgaagaagtgatgggcgaaacaggtgagattcatttcaaaaccgataaccgcggtttattcgaatactctctgaaaagcttttccgaatacggcctgcttctgacagaagtcagcctagatctgcacaacagcgatccgaagggcaatattatgacagaatacgaagaaaaattctccgcactcggccagccgatttaccgggccgaagttgaatggagaacaaaagacagactctgatgcgggagtctgtttttttatgccgccatttgctaccattatatcaggagggatcaagatggagacattgaatattgggaatatttcattaacatggctggacggcggtgtaacacatatggacggcggagcgatgttcggcgttgtcccgaagcctttatggtcgagaaaataccccgtaaatgacaaaaaccagattgaattaagaacagacccgattctgatcagaacaaacggcctgaatatattggttgacgcgggtatcggcagagggaaattttctgataaacaaaaaaggaattacggtgtaacacaggaatccaatttaaaacactctcttcgtgaactcgggctttcctgtgaggacattcatattgcggcgatgacccatcttcattttgaccatgcatgcggcttgacggaatacagcggagaggagcttgtctctgttttcccgaatgcccgcattatcacttctgcaacagagtggcgcgaaatgagaaaccctaatatcagatcgaaaaatacatattggagagaaaattgggaggcggtacaagatcaggtcgaaacctttgagaacgagtatcagctgacagaaggcattacgatgcaccacaccggaggccacagcgacggccacagtgtcatcgtcttagaagacggcggggagacggctgtgcattttgccgacctgatgccgacgaatgcgcataaaaatccgttatgggtgctggcctatgatgattatccgatgacctccattccgcaaaagcagaaatggcagacgttcgcggcagaaaaaggcgcctggctgattttctatcacgacgcgatttacagagcggtaaaatggggagaagacggcgaagtggctgcatctgtcaaacgggagagaaaataagcggatcgatgatttacctgtatgaatttcgggaataaaagcaaacctaagacaaattgctttgaaaggaagagacaggtgaatcaatttcaagtgacgaaagatggagaaatcaaaacaactctgcgcggattagaagtgctttctacgccttttttaaataaaggggtggcctttacacaggaggaaagaaaggaactcgggctcgagggatttctgccgccgaaagtattgacaatcgaagagcaggcgaggcgggcctacgaacaattcagttcgcagcctgatgagctgagcaaaaatgtgtacttgaccgctctccatgatcggaatgaaacattattttacaggctgttaaatgatcatttaggcgaaatgctgccgatcgtatatacgccgaccgtcggcaccgcgatccagcgttacagccacgagtacagaaaaccccgcggtctgtatttgtcaatagatgaccctgaaggaatgcgcgccgcatttcagcagttcggaaaaaatgaaaacattgacttgatcgttgcgacagatgcggagggcattctgggaatcggtgactggggcgtcggcggcatcgccatttctgtcggaaaactcgcggtgtatacggcggccgccggaattgatccgtcacgagtgcttgcggtcgttttggacgcggggacaaatcaagaaagcctcttaaatgacccgctgtatgtcggaaaccagcattcaagagtgcgcggcgagaaatatgaccgctttattgatgagtatgtctcgcttgcccgggaaacattcccgaatgcgctgcttcattgggaggatttcggcacggctaacgcccgcggcatattaaaacggtataaagataaagtctgtacgtttaacgatgacattcaaggaacgggcgcggtgtcgcttgcagctgttttagcgtgtgcgaaagcatcaaaagtgcctttaaaagagcataaagtcgtcgtcttcggcgcgggaacggccggtatcggaattgctgagcagctgcgcgaagctatggtgcataacggattaagcgaagaagaatcatacagccgcttttggtgtatcgacagaaacggattgttgacggatgatatgaaggacttgcgtgattttcaggttccgtacgcccgccctgctgatgaagtgaaagagtacggccgcagcggtgaaggcggatcaattgatctggcggagacggtgcgacaggccaagccgacgatcctgatcggcacatctaccgtttcaggcgcatttacggaagaaatcgtcaaagaaatggcctcacatgtcaaacggccggctattttgcctatgtcaaacccgacgacattatcagaagcaaaacctgaagatttaattaaatggacggaaggccgcgcgcttgtcacaacgggaagtccgttcccgcctgttgcgtataacggcgttacctaccatatcggacaggcgaacaacgcgctcgtattcccgggactcgggctcggaacgattgtgacaaaagcaaggctcattacggacaatatgttcgttgcctgcgcgaatgccatcgccggtatggtggacgtcggcaagccgggcgcgccgatgcttccgaaagtggaggatctcaggacggtatcggcaaccgtggcggtagctgtagctaaagctgcgattcaggacggtgtagcggaaacggaacccgaggatctgatccaagcggttcaggacgcgatgtggaaccccgtatataaacgaattcggccgatgtaaccgaataaagcccaaaacgctgatggttttgggctttattttttgcttgtccgaattatgaggcgacagaatcaatgacatcgacaatctggcctgtttttgcattgaccataacttcatattgctccagttcgccgaatgccgaacgtgtcacgccggttttgtatacctggatggtttctccgtttacctggtagggctccggctctgtgtaaatccatgatccgtctatcggcccgcgctgtttaaaagccgctttcacgatacggagcgctttttctgaagagatataaggtttcatcgcatactttttcactgcgatggcagcgcataatccgactcctgcacctaagagaaaatgacgtaatttcaatatgaagcacctccaattatgtcgtagtttttattatacagaagatgccagacggtgttaagtaaagcggcggttttacagcccattcaatctgagcgcttggaaaacggttgtttttctaataaaataaaagcattacatagaaatgaggggaaaatatgaatgaggaaacgaaaacgcttttccggacgctgacgcagcttcccggcgcaccgggaaatgaacatcaggtccgctcctttatgaaacgggagcttgcgaaatatgcggatgacatcgtgcaggacagactcggaagtgttttcggagtaaggcgcggcgctgaagatgcgccgaccgttatggtagccgggcatatggatgaagtcgggtttatggtgacacagattacggataacggcatgctgagatttcagacgctcggcggctggtggagccaggtgctgcttgcccagcgcgtcgaggtgcagacggataacggaccgattatcggcgtcatctcaagcatcccgccccacattttaacggatgcccagcgcgcaaagccgatggagatcaaaaatatgatgattgatatcggtgccgatgacagagaggacgcggtcaaaatggggatcagaccgggacagcaggtcgtgccggtctgcccgttcaccccgatggccaacgagaagaaaatattgtccaaagcgtgggataaccgctacggctgcgggttaagcattgaactattaaaagagctgcacggaaaagacctgccgaacaatctgtacgccggggccaccgttcaggaggaagtcggcttaagaggggcgcagacagccgccaacatgattcagcctgatcttttcttcgcgcttgatgccagcccggcaaatgatatgagcggcgataaggagctgttcggccgtctcggcgagggggtgctgctccgcattctcgacagaacgacggtcatgcaccgcgggatgagagagttcgtccttgatatggcggaaacgcacaatatcccttatcaatatttcgcttcaggcggaggaacggatgccggacgcgtccacatatcaaacagcggggttccgtctgccgtcatcggcatttgttcaagatacattcatacaaatgccgctatcatccatgtcgatgattatgccgcggcgaaagaaatgctcattaagctggtcatggcgagtgacaaacagacggtcgaaacgatcagagaaaatgtgtaaaaaaataagcagtcaataagtccctttgaatacttattgactgctgtttttacattctgttttaagccgcatgatcgagacagttctttgttgtgaatataagtgtaaagcgtattgtaaatagaattaggtaacatatattatttttcaatattattatcaaaatggttccgatccagataaacaaccttcgaacctttattgcaatgataaacgtttttaaatcaaaaacatgctgcaagcattgagatgagcagcgatttcacaaagtcgagtcatttgcatttttatttgttctgcaagaaggtatgattatgacaaaaaagacaaatataaactttcctcttgaactgattaatactgaagtggtgagtgtaggtaagcaggaccgcataaaggcggcctgcttattctgtttcaaataaataagagagtgctttcatcgcttgatttacggtttcgaccgtgatattcgcttttccggaaagctctttcagcggatgatgaagttctttcggacggatgagaatgagcggctttccttttgcgatggcataagaagcatccatcgcggtattccactgtttatatttctcgccaaacagggcgatcacaaaatcggctttttccatcagcacctctgtacggaaattgttgatatcagaagctctggcgtcttttaaaacagaatcgggctgcacgcccataatctcttctccgatattgtctgagcgttcatggttttccatcggaccgacaaacgtaatcggcaggttcagcgcttttgctttttgtttgatttcatcccgccaatcactgtggatttcacccgctaaatacacgacaaactgcatctttagcccctccttatgtacatattcagattttcgtacggctacaagcaaaatggtaaacgaaacttgcttgataatgcaaatgaaatatgataatgatattgcatatagttggtcttgccgtaaacagtctggtatgatccaattggacaaacatcagcatataaaaactcataatccagatggaggaatgacaatgaaaaagattgaaagcacggaagaattgcaaaaagcggtacaagacgattgggcggtatttatgttttcagcggattggtgcccggactgccgctttgtggagccgtttctccctgagctggaagcggactttcctgaattcacttattactacgtagaccgcgatcaatttattgatacatgcgcggaatgggaaatttacggcattccgagctttgttgtgtttaacggaggaaaagaagtgaaccgcttcgtcagcaaagaccgtaaaacaaaagaagaaattgagcaatttttaaccgattcccttgctaaagcataaaggaggccacgggctttgaaaatgacgtcaaggaagctggcggatttattaaaacagcgcctgcagcacgagaaccgatccttcttttttgacagagaaaaagacaacctccgtgttgaggatcaaacgaccaaaaaaggcatcacattggagctcccgccgatcattgcgaagtgggagacgaaaaaagaagaagcgatcgacgaaatcgtctactatgtgtcagaagcgatggaggcgatggaaggaagcggacaggagatgtccggaaaggaagccggaatctatccggtcatccgctccacgtcatttcccgatcaaacgagcgacggcattccgctcgtgtatgatgaccatacggccgaaacgagaatttactacgcgcttgacctcggcaagacgtaccgcttaattgacagccgtatgctcgagaaagaaaactggacaaaagaacggatcagggagacggcgtcattcaatctccgctctcttccttcggtcgtgaaacaggatacggttgcggataattatttttattttttcagggcgaatgacggctatgacgccagccggattctcaatgattcgattcttcatgaatataagcaggccgctgaaggcgaattggcgatttccgtcccgcatcaggatgtattaatacttgctgacattcgaaatgaatcgggttatgatattttagggcaaatgtccatgagcttctttgcaagcggcacggtgccgattacggccctttcatttctgtataatgaaggcagactggaacctgtgtttatcatggcgaaaagccggccgaaaaaggattagaaaggatttttcttatgaacgctttttacaataaagaaggtgtgggagatacgcttctgatctctcttaaagatgcagcacgcgaagaaatcggctatgaaagagaaggcgatgtcgtcagaatctttaacaaagaaacaaaagaaacgacgggctttaacatttttaacgtgtcttcttacttacagattgaagacaacggccccgtcgctttgtctgagactttcgtacaggatgtgaatgaaatactgaacagaaacggcgtttcagaaacgctgacggttgacctttctccgaaatttgttgtcggtcacgttgaatcgaaagaaaaacatccgaatgcggataaactgaatatctgccaagtgaatgtcggagaggaaacccttcaaatcgtttgcggcgcgccgaacgtggacaaagggcaaaaagtcgtcgtcgctaaagtcggttcggtaatgccgagcggacttgtgattaaagacgctgaattaagaggcgttccgtcaagcggcatgatctgctccgcgaaagaactcgctttgccggatgcgccggcggaaaaagggattcttgttcttgaagacagccgcgaggccggcgaagcatttcaattctaactcccataaataagcgcacagaatcgaatgatgtgagagaaagccgttaagcaggcctgcttaacggctttcttcagttgggagcttaatcttttctgagccgcccggcaatggtatactaaatatcgtcccagactactaaaaagggagttagagagtgattaaacatgagttggctgaataaattttttgacttatttttaggtgaaaaagaagaagagcatgaacgtgaaccgaacacgcatgcccaaatccagaaacagcaaataccggatcagccagaaggcaaattaacgcgcatggaagatcctaaaatatattacgaatatccgaaagggaatttccgcttcccggtcgttccggacggctataagcgaacggagcaaaaccaaagacagcgggaaaggcacgaacgccgccagccgtcccggggttatgccgccgggaaggagcaaacggagcggaaacagcatacacataaagagcctgatacggtgaaaaagccctttaaaccgtcatccattccttcaccggtttacggctttcaatctcagcacagcatcaaaaaagcgcctatttccgaaaagcggcgtgaagagaacgtaacattgctgtcagaggagcaatttgttccgccaaaatccggtcaggaaacggaaaaagagcccgtcttcacaacatccggtataacaaaacagacgaatgaccggccagaaccgtttgcgaaacaagaaacggaagaaattccggccgttaaaaaagaggagcttcacacggaggctgagaatgcaaaagagcaagtgtttgcagcaccagaaccgcagcaggctgaagagctggagcacaccgaaagcgcggagtctgccggctttacagaagaacaagagcatgaacaaacccgcccgcagcctataagagagcctgagtctgaagcatcccgaacggctgaaaacacagaggaacaagcggcgccggagggggaacatcaggagcctgagccggaaaaagcaccgccttttgaaaccgcagaagaaccggtgtatacatacacagaacccggatacgaggaaattcagccgcagtctgaagacaagcccgaatcagctgaacccgacgcgaaacaggaagcagactctcagcctgagtacaatgaagcagagcggcattcagaccccgagcctgaacctgtaagcattgagacggccgatgccccatcccggcctgccgaagaaaaaacggagcatcacggacagcctcagactgtgagaaaagcggagcagccgaaagagcgcaatgttccgtttaacgtcatgatgcttaaaagcgataaacacaagcagacgaagacgccagagggcggagcgagctatgtctttccgaatctgtcgcttctggacgtaccgccggcgcaaagacatgacgaccaatcgtggattgaagaacagcgcgagcttttaaacgttacactgaaaaactttaatgtgcgcgcccaagtcgttcatgtcacacaaggcccgtccgtcacacgttttgaagtgcatcctgagcccggagtgaaagtaaacaaaattacaaacttagcagatgatattaaactgagcctgtctgccaaggatattcggattgaggcgccgatccccggtaaaaacacgatcggcattgaagttccgaaccgcgtaagcaaagtcgtcgatttaaggcagatgatcagaagcgccgctttcaggacgaatccgtctccgcttacagccgcgctcggtgtcgatatttccggaaacccggtcgtcattgatttgaaaaagatgccgcacgggttgatagcgggtgcgacaggatcgggaaaaagcgtctgcatcaataccattttggtcagtctgctttataaggcggatccgagtgatgtcaaaatgcttctgattgatccgaaaatggtcgagcttgcgccttataaccaaattccgcatttggtcagccccgtcatcacggacgccaaagccgcgaccgccgcgttaaaatgggttgtggaagagatggaacggcggtatgaactgtttgcccattcgggtgtgagagatatcggacgctttaatgaattaacggccgatcataagacaggcgaaaagctcccttacctcgtagtggtcattgatgagcttgccgatttaatgatggtcgcgccgaacgatgtggaagaaagcatcgccagaatcgcgcagaaagcgagagcctgcggcattcatctgcttgtcgcgacacagcgtccgtctgtcgatgtcattaccggaatgatcaaggcgaacataccgacgaggattgcattctccgtctcaagccaggtagattccagaacgatcatcgacatggcgggagcggaaaagctgctcggaaaaggcgacatgctgtactgggaaaacggtaccggaaaaccggtgcgcctgcagggcaactttgtatccgacagagagattgaccgcgtcgtctctcatgtcagaaagcagctgccgccttcttatttgtttgaacaggaagaactgatcaggcagggaaccgcccttaaggaagaagacgaactgtttcctgaggcgtgccaattcgtcgtggagcaaaacagcgccagcacctcaagccttcaaagaaggttcagaatcggttataaccgcgccgcgaggctgattgacatgatggaagccgaaggcatgatctcagaagcgaagggcagcaaaccgcgtgaagtgctgattacggccgctgacatttctcaagaataagaatatcgttcatttttctcacaaacatggtatgatagtggatggaccatcaaaactgcatcactgtcacgcgctgaaatatcatgcggcaggtttaatcaaaaagaaagttacagatactgacgataacgtaaaaataaatggaagcgccgctgtgcgggcttttcgcccgctgcggtcgcaaaatgaaatgagcgtcatatactggggaacagatagacgtttgttggaggtacgattatgactgtttatcattttgttggaataaaagggacaggtatgagcccgcttgctcaaatcctgcatgatacggggtatcaggtgcagggatcggatatcgagaagcagattttcactcaggctgcccttgaaaaaagaaacatcccgatctatccgttcagcgccgataacatcaaacccggcttaacggtaatcgccggaaacgcattccctgattctcatccggaaattgcaaaggcgctcgatgaagggattcctgtgatcagatatcataaatttttagctgaatatatgaaaaaatacacaagtgtcgcggtaacgggcgcacacggcaagacgtccacaacgggcctcttggcacacgtgatgcagcaggcgaagccgacttcgtttcttatcggggacggaacgggcagaggaaatgaaagcagcgaatactttgtatttgaagcttgcgagtaccgccgtcatttcttaagctatcagcctgattatgcgattatgacgaatattgattttgaccaccctgattatttcgccaacattgacgatgtgtttgatgctttccaaaacatggcgcttcaagtcaacaaaggcatcattgcctgcggtgatgacgagtacctgccgaaaattcacgccaatgtgcctgtcgtttattacggcacgggagaagaaaacgattttcaagcgagaaacatcgtaaaaaatacggaaggcacgacatttgacgtctttgtccgcaatacgttttacgatacgttctacatcccggcatacggccatcataatgtcctcaattccttagcggtcattgcgctctgccactatgaagagatagacgtgaacatgattaagctcggacttgaatcattcggcggcgtcaaacgcagattcaatgaaaaagtgatcggaagccaggtactgatcgacgactacgcccaccatccgactgaaatcaaagtcacgattgaggcggcgcgccaaaaatatcccgaacgtgaaatcatcgcggtatttcagccgcatacgtttacacggacgcaatcattcctggatgaattcgcagaaagcttaagcgcggccgaccgcgtgtatctgtgcgacattttcggctctgcccgtgagaacgtcggcaagctcacgatcacggatcttcaggaaaaaatcgataacgcagaactcattgaagaaaatgacacttccgtgttaaaagcgcatgaaggcgcagtgctgatcttcatgggcgccggagacattcaaaaatatatgagggcctatgaaaacgtcatagcgtaacgaaaaagcagtggggctctcactgcttttttgcgcgtgctgcaaagggatttaccgataaacggagaaatagtatacatacagacctttcatatatgtttatcattttaagaattgggtatataccactatatcctgcattaaggaggtattagatgatcatcattctttacttaagcgtcgcactcattgccgttgcatttctcatcctcgtcatctatctgtccaaaacattaaagtccgtgcaaatgactttaacaaacgtagcctcgactttagacggccttgaagggcagatgaaaggcattaccgcagagacagccgagctgttacataagacaaaccgtctcgcggaagacattcaggaaaaatcagagaaattaaatacggttgtccatgctgtccaggaagtgggaacttccgtccagcagtttaatacatccataaagcaggcagcaggttctgttacggcctctgtaagagagaatcaggataagatcagtcaggttgtcacctggagccaggccgctatggaaatatgggacaagtggaagcaaaagaaaaaaacatcgctttaatcataagaaaaatccactaaggaggaatcataatgagcaaagatggaatcaatagtaaggattttttaatcggaacgctgatcgggggaattatcggcgcgacaacggcgttgtttctggcgcctaaatcaggtaaggagctgcgcgacgatctcggcagtcaggcttctgcgttaaaggataagacggacagaatgacggccgacgcgaaagaaaaaggctctcaatatgtcagcatcgccaaggacaaaacatctaatatcacccagctggtagctgatcagtcaggtcagattatgaataaagtgaaggatttaaaagaccgttctaagagcacactaaccgagaaagccgaagagacgagaagcgaaatgcaggacacggcccaaagcatcaaggccgaagcggaagacgccggggaaaaagccggtcaggcaaatcgctgatcttcaataaggagagataaccgacatgacaaaacagctgatatcgtctgaagaagagtttaaaaatgccgctgagaaagaaaacacgctcgtgtttttaaaacacagcacaacctgcccgatcagccaagccgcgtttcaggagtttgacgcctttgcatcggagcattcagaagtaccttcttattacctgcatgtgcaggacagccggccgctttcaaactatatcgccgaggcatacggcgtgaaacatgaaagcccgcaagtattcgttattacaaacggcgaagtgaaatggcacgcgtctcattcacaaatcacaaaaaacgcaatagagcagcacctttcataattgctggccgccggttgataccggcggtttttttttttgaaaaaaactattgatcatttcagccggatcatgtaggatatcaatatatactgcttcaatgcataaaagcttaaaagcgttttggtgataaagtcgaatgtgaaaaaatttattatttcatattcctattttcgcataactgtagtaagatgcatgttaaccattaaaataaaacatagcatagaagggatgaaaaagatgagcaacaaggaattagagagtctaagacagcaagcagacgcactaaacttagaaatccttaaattaatcaatgaacgcggagccgttgtaaaagaaatcggtaaagcaaaggaagcacagggtgtcaaccgatttgaccctgtcagagagcgtacaatgcttaaccgcattattgaaagcaatgacggcccatttgaaaactcaacgatccagcatattttcaaagaaattttcaaagccggacttgaacttcaagaagaggatcacagcaaagcgttgctcgtctcccggaagaaaaaagcagaagatacgatcgttgacattaaaggtgaaagaatcggtgacggcgatcagagattcatcgtcggaccttgtgccgtagaaagctatgagcaggttgccgaagtcgcggccgcagcgaaaaaacaaggcattaaaatcctgcgcgggggcgcgtttaaaccccgcacaagtccgtatgatttccaaggtctcggcgtagaaggcctgcaaattcttaaacgcgtcgctgatgaatatgacctcgcggtgatcagtgaaatcgtaacgcccgcccacattgagcaagcgattgattacattgacgtcattcagatcggcgcgcggaacatgcaaaactttgaattgctgaaagccgccggttccgttaaaaagccggtattgttaaaacgcggtcttgccgcgacaatttcagagttcatcaatgcagctgaatacatcatgtcacaaggaaacgaccaaatcattctttgtgagcgcggaatcagaacgtacgaaacggcaacgagaaacacactcgacatttctgccgtgccgattttgaaacaggaaactcacttgccggtgtttgttgacgtcacacactcaacaggccgccgcgatctcctgcttccgacagcaaaagcggcgcttgcgatcggcgctgacggcgtgatggccgaagtacaccctgatccttccgttgccctttcagactctgcgcagcagatggatatccctgaattcgagaaatggctgaacgaattaaagccgatgctgaaagtaaaagcataatacaacgttccgctctttaaaggccgcctcgcgcggcttttttttcgtatcttcattttatttaattataaaatgaaagtgaacgttttcatcattgggaaaaacgtgtataatttcatgagagatatttaaatttgatgaataatgaaaaataatgtacactactgacttacgcttacaatcataaacgacagaatgcgaaatcgtacgacatttctttacataaagtgtttatgctatagataaggataagtgtatccagtaaaaggagtggtttcagtgagcaacattacgatatacgatgtggccagagaagcaaatgtcagtatggcgactgtttcccgcgtcgtgaacggcaacccgaatgtaaaaccgacgaccagaaaaaaagtattggaagccattgaccggctcggctaccgcccgaacgcggtggcaagagggcttgcaagcaaaaaaacgacaacggtcggcgtcatcatccctgatatctcaagcattttctactcggaacttgcgcgtggaattgaagatatcgcgacgatgtacaaatataatattattttaagcaactcggatcaaaatcttgagaaagaactgcatctgttaaatacgatgctcggcaaacaagtggacggtatcgtatttatgggcggcaacattacggacgagcatgtcgaagaatttaagcgctctcctgtgccgatcgtcttggctgcatcagtggaagaacagggcgagacgccttctgtcgccattgattatgaacaggcgatttatgatgccgttaagcttttcattgataaagggcatcgcgatattgcattcgtctccggaccgatgcaagagccgatcaaccgttcgaaaaaactgcaagggtacaaacgggcgcttgaagaagcggcgattccgtttaacgagcaattcgtagcggaaggcgattacacttatgattccggtatggaggcgcttcaaagcttgatgggccttgaccggaaaccgacggcgattctttctgcgacggatgaaatggccctcggcattatccatgcggcccaagatcaaggtctttcgatacctgatgatcttgatattatcggttttgacaatacgagattgagcctgatggtccgccctcagctttcaacagtcgtgcagcctacgtacgatatcggcgccgtggcgatgagacttttgacaaaactgatgaacaaagagccggttgaagagcatatcgtcgaattgcctcaccgcatcgaattaagacaatcaaccaagtcataaaaaaacggaaaagcaagcttcactctgaggggtggaatcttgcttttttacttgagtaaggagaagatatgaaacgttttgattatctgacgcccgttggctttatgttaggctgtattattgtcgcaatcggtattctgtcagggacgggactggcgggaatcagttcatttttggatctgacttcttttttaatcgtcacaggcggccttgccgcggcggtctttatcagctttccgccgagggatttaaagaaaaccccttctgttctgaaacaggtattctcccgtcaggatgacaatgtgaaagagcttgtcagagtatttgtcagcctttcggagcaggcgcgcaggcaggggcttctgtctctggatgaccaggcgcgggagatcaaagatccgtttttaaaaaaagggcttttgcttgcgattgacggctgggacgaggaaacgatccggctggtgatggattctgagatcgccgcaatggaagaaagacacagaaaaggaagacgcgtttttgaaaaagctggtgatttcgcacccgcctggggaatgatcgggacgctcgtcggactcgttctcatgctcaaaaacttaaatgacccgcataccctcggaccgaacatggccgttgcgctattgacgacgctgtacggagcgctgcttgccaatttggtgtttatcccaatcgcggcaaagcttgaagaaaaaacggaaagtgaaattttcatcaaacaggtcatgatcgaaggggttgtcggcatccaatcgggcaaaaatccccgcaacctcgaaagtcagctcgtcgtcttcagctcaagagaagactggcgtaaaggacagcctgcgaacaagaaaaagggcgctgtccatgaagcttagaaaagagcgttttgaaagaagaaacaaaccggaacattccggcggttcaccgagatggatggtgacgttcgctgacttgatcacgctcattctcgtgttctttatcttgcttttttcgatgtcgcaaatagacgcggaaaaatttcaatctgccgtttcatcgattcatacaaacggcagcggaggtgaaccggcgtcatcagacaaagcaaacgaaaataaagaacaggatttgctgttacaaaacgtgaagacatacataaaagcgcatcatttgagttccaaattgacggcgaagcgcgatgagcgcggagtggttcttgtgctgcaggaggccgttctgtttcagacgggaaaagcggatgtgctgaaaaacgccgagccggttctgcatcagatcgcggtgcttttaaaaacaattccgaatgacatacaggtagaaggccatacggacagccgccggatttccacctatcaattcccgtcgaactgggagctgtcgtctgcaagagcggcgagtgtgatccagtattttaccgcgaatgaagacttttccgccaaacggtttatctctgccgggtatgcggatacgaaacctgtgaaggacaacaaaagtcccggacatatgaaagaaaaccgccgtgtagaaatcgtgatcaaaaaaacgacctcctcataaggtcgttttttattttgttttataccgctgctcagaccggatggcaaaaagtgctttttccacggtttgggcatttttttctgaaatttcttctttgcgtggaatcggaggatataattgttcaggatcactccaaaaagcgggcagcgtgcagggggaatgcttctgccatttatcaatccatttctgcggtatgcgctccccgggatcaatccctttcatctcaagccaaatgcggctccatgctctcgggacgactctccaaatatcgtatccgccgccgccgaccgcgatccatctgccgctgcaatattgatgggctaatgaatgagcgagccgcgggatctcctgataaatggagattgtattggacaggtgtgtcaatgggtcgtaataatgggcgtccgcaccgttttgggtaagaatcacatccggcttaaaaaaagccgcaatttcagaggcggccgttttgtaagcgtggagaaaggaatcgtcctctgtgaaagcgtccagcggaatgttaaaagaatagccgtagccttgcccgcttcctttttccagtacctgccccgtcccgggaaataaataacgcccggtctcgtgaaaagaaacagtgcagacatcagacctgtcgtaaaacgtaaattgaacgccgtcgccgtggtgggcgtctgtatcaatgtataacacttttgccccgtagttcttctggatgtattggatggccacggcgctgtcattatagatacaaaagcctgacgccctgccgcggaagccgtggtgaaggcctcctcctaaattgcaggcatgcctggcttgtcccgtcataacataatctgccgctgttaaggtgccgcccaccagaagcgacgcagcttcatgcatgccggcaaaaacgggggtgtcttccgttccgagaccgtagctttctccttctgcggcagggagccggcccgcgcccgcaagttccaccgcctgtatataatcctccgtatgaacgagacccagctcttctttagtggccgtgcgcggtttgacgatgtctccatcgtcaaacgcgtccgccgcctgaagcagatcgtatgttaaaagcacgcgctgctgattgaacggatgatcctgatgaaattgatacgtctgataagaaggcgagtaaacaaaaacgctgtctctcatggctgatccctcaaatgtttcggccataagacattgtatccggcttcatgaacggcacggataaaagggagcggattcatcgtctttacccggaagacgagaatgttcgacccggcggaatcatggggatagacgagcacactcaggatttgcagctgaagatcacggcacatgcagctgagatcagcaaggctttttgtcatatccgtcaccaggatttccacctgtgatcccggctgggccgcgcctgtcaggctgacgaaagtccggagcacgtcggttttcgttaaaatgcccgtcagcttatgatttaccgtaatcggcagacagccgatgccgtgctcataaaaggaagcggatatttcttccacaaagtcaagcggatgggcgcagatgacattccgcttcataatggtctccactttgtttgtcagaaacgcgccgcgttccttttgttcgaagctgccggggccggcctgtttaatgtctctgtctgtgacaataccggtgacgtgcagctcgtcgtcgatgacagggagatggcggatatgatataccttcattttacggacggctgtttcaatggagtcgtgttttgagacggtgatgacgtcccgtttcatgatttgttctgcaatcatctttttatcccctttgtatgtcagtcaatacataaaccgctgataaaaacgaagcctgtcgaactgttcaattgactcctgactgacgtgcctgccgatgcgggccatcagacaattggccggatgagagctgatttccggttcatccgttgcaaaccagacaagacccccggcattcatcatcttttccatgatctttctgtattcccacacatcttttttcattccttttaaatcccaatgccagtaatattccgtcgtcatgatgatgtagcgttccatctgttcatccatcatgctgactgtcagcaacgtttttccgacagaacagcccctgtagccgggagcgacctcgatcgccccgagctcaaggagatcttccatattgccgtcagaccaccgttcaagcggatcaggatataaatacgtcacatagccgataatcgtctgtccgtccctggcgataatgatccgaccttcaggaagcccggcgatctcgattaacgctttgtgctgttcatgaggaaggcgaaaggctgtcaggccttcatgaaactcatactgtgctaggtcctttggaggaacgggcccttctaccaatagagggccggctgctgtctgaattgatgaagaatggtacgttttatgatgtttcactgattcaccgcctgtcggttcttaataaaaacacatctctcttaagcataacaaaatataaagcgttttcaatagtgttgtaatttatattttaaaaattgagaaaactgtgaacatctactataattagtctatagataagcaaagggggatgttgcatgaatttgaaagcgttgccggcggaaaaggggaattatcatctgcgaaattatgaggaaacgtaccgcagcttcgattggaaagaggtcgaagcggagttttcctggcatcagacggggaagctgaatgcggcgtacgaagcaattgaccgtcatgccgaatcatttcgaaaaaacaaagtagcgctgtattacaaggacgcaaatcggaatgaaaaatacacatttaaagaaatgatggaggaatcgaaccgggcgggaaatgtactgagacggtatggaaacgtggaaaaaggggaccgcgtttttattttcatgccgcgttcgccggagctgtactttatcatgctcggcgcaattaaaatcggtgcgatcgccggccctttatttgaagcgtttatggaaggcgccgtcaaagaccgcctgttgaacagccaggcaaaggttgtcgtgacgacacctgaactggccgaacggattccggcggacagcctgcccgacctcgagcatattttcattgtcggcggcagcaaagaagcgggagataaaatcattcattatgataaagcggctgagggagaaagcacgagacttgatattgaatggatggacagaagagacggctacctgcttcactacacatcaggatctaccggaacgccaaaaggtgtgctccacgttcatgaagccatgattcagcaataccagaccggcaagtgggtgcttgatcttaaagaagacgatatttattggtgcactgcggacccgggctgggtgaccgggacggtgtacgggatatttgcgccgtggctgaacggagcggcgaatgtgatcgtcggcggcagattcagtccggaaaactggtacggcacgattgagaagcttggtgtcagcgtctggtacagcgctccgacggctttcagaatgcttatgggcgccggagatgaaatggcatccaaatttgaccttacttcacttcgtcacgtcctgagtgtcggagaacctttgaaccccgaggtcatcaagtggggacataaagtattcggcaagcgcatccacgacacgtggtggatgacagaaacgggcggacagctcatctgcaattatccttgcatggagatcaagccgggctcaatggggaaaccgattccgggagtggaagcggcgatcgttgacaatcagggaaatgagcttccgccgtaccgaatgggaaatctcgccattaaaaagggctggccgtcgatgatggattccatttggaacaacaaagagaaatatgattcttattttatgccgggcggctggtatgtttccggagattctgcttatatggatgaagacggttatttctggttccaaggcagagtcgatgatgtcatcatgacatccggcgagcgcgtcggcccgtttgaagtcgaaagcaaacttgttgaacatccggcgattgccgaagccggcgtcatcggaaagccggaccctgtccggggagaaattattaaagcgtttatcgcgctcagagaagggcatgagccatccgatcagctgaaggaggacattcgcctctttgtaaaacaggggcttgccgcgcatgccgcaccgcgggaaattgaattcaaagataaacttccgaaaacacggagcggaaaaatcatgagacgtgtgctgaaggcatgggagctgaacctgccggcaggcgacctgtccacaatggaagattaaagacggcgttgacatcgtatcttatttatgttaaaaatgagtaagcttcatacgaaaaggttttgattgagacaagtaggatatctgattgttccagagagctgatggccggtgaaaatcagcacataagatatgccgaatacactcatgaaccgcttttgcgaacaaagctattccaaggctttcagtagtgaaagaacggacacggtccgttatcaaaaagagtgataaaagcttttttatgtttttattagtagggtggtaccgcgattatatcgtcccttcgttttaaacgaaggggcgttttttattttcataaacaaaggagcagacaaaatgactaacttattagaggatttatcattccgcggcttaatccagcaaatgacggatgaagaaggactgaataaacagctgagcgaagaaaaaatccgtttatactcagggtttgacccgacggctgacagcctgcacatcggacaccttctgccgatattgacactgcgccgtttccagcttgcaggccaccatccgattgcgcttgtaggcggcgcgacgggactgatcggcgatccgagcggcaaaaaagcggagcgtacgttaaatactcaggatatcgttgtcgaatggtcgcaaaaaattaaaaatcagctttcccgatttttagatttcgaggcaggagaaaaccccgctgtcatagcgaacaactttgattggatcggaaagctgagcatcattgaatttctccgtgacgtcggaaagaacttcggaattaactacatgcttgcgaaagatactgtaagctcaagaattgaaaccggaatttcttacacggaattcagctacatgatcctgcaatcctacgattttctgaatctgtacagagaaaagaactgcaaactccaaatcggaggcagtgaccagtggggcaacatcacggccggtcttgaactgatcagaaaatcagaagaagaaggggcgaaagctttcggtcttaccattccgctcgtcacaaaagctgacggcacgaaattcggcaaaacggaaggcggcgccatttggcttgataaagaaaaaacatcgccgtacgaattctaccagttctggatcaatactgatgaccgcgacgtcgtcaaatacttaaaatactttactttcttgtcaaaagaggaaattgaagcttatgctgaaaaaacggagacagctcctgagaaaagagaagcgcagaaacgtctcgctgaagaggtgacggttcttgtacacggccgtgaagcgcttgagcaggccgttcatatctcccaggcgctgttcagcggcaatattaaagagctttccgctcaagacgtcaaggtaggatttaaagatgtaccttcgtttgaaaaagaccgctctcaagaactgtctttagtagacgtgctagtggaatctaaactgtcgccttcaaaacggcaggcccgcgaagacattcaaaacggagctgtttacattaacggcgagcgccggacggacatcgggcatcttctgactgcggaagaccgcattgaagatcaatttaccgtactgcgccgcggaaagaaaaaatacttcctgatcacgtactgaaaataaaaagcagtccggccgctccatgcggcaggctgcttttttatgttttgtgaatactgcacggggaaatgagtacagtacatagtataagcaaaacagggaaggggtgctgcgccgtgaatttcatgtttaccatcgccaaagaaagattgcagcgggatcattgggaacagcagcaaagcataaacgccgaagccgaggaatcagagacggaagaagaaaatccgacatcataaaggtaaagcctccattctatggaatggaggcttttgattgtcaccatatcagcctgacggcggccatcagcacgactcccgtgatgaccgtgatggataagctttttgtcagcatcgcgcaaagcaatgtcgggatgagaacgatcattgctttccaatcaaaggtcaaagcgctgtttgttttcacaatcatgctttccgttaccagagccgtcaaaatgcaaagcggaataaaggagagccattttaaagccaattcaggcatctgaatgttccggacaaatataaacggaacaatgcgcggcacaagtgtaacaatcatgcagccgagtataatccagatcatttgtgtgctgatgctcatttgtccgtcaccaccccgatcgttgccacaattacggttgagacgatgaccgcgatgtgtgacgggacgaaatacgataacaagaccataaaaatgatcatatagagaattaaggagaggctgtgcttcagcttttccgaagcggacgactgcaattgcagcacaagcagcgccgcaaacatagcaggcaaagcaaagtccaggccgagagcgtaaggatcagatatccattgtccgagaagcccgcccatcacgcaggaaataacccagcacatgtaagcggttatattgaggccgttcatccacttatcgtataacctgccgttctgagccgctttgttcaccgctactccgaaagattcgtcagtaagcagagccccgaagccgatatttttcgccagagagtatttcgtgaaatacggcgcgatggtcaggctcagcagaaggtgacgcagattgacgataaacgtcgttaaaataatggcggaaatcggactcccggaaacaaggagcgagcaaataataaattgggcggcgccggcatagacacacaaggataacaaacagatttcaagaatgcttagatgagaggcaaccccgacgatgccgaaagcaaaaccgatgctcatatagcccagcagcgtaggcacacaatcccgcaccccctgtaaaaacgtatcgttcatttcccgggaaacggcggttttttgcacttctgtgttaatcattttttatactcctttcatagagattataatgataacgactaatgaaaaaatcaaagaaaatacggttcacatttatatgaaccgatttccggtgacgacatgaaataacgaatggttttgtttcatcaggccttcaactttttcagccccgacttctttcacaagctccgcgaacatcagatcgtgcctcatatattccatggccacgagaacgagagcggggtcttctgatttaatggcccaggcattcgtctgcggagaaaaattggcgattaagacttctttattatctcgggcagctatcgttaatcttccgcccatccgtttctccgccacttcaggagacatattatgatttgtcgtatttccgagcttcacttccggagggccgaacacaatcgaaaagacgggcaattgttcggcggcgcgtttattagcggcttcttgaataaagggaatctgctgttcccagacagacagccacaactcttcctcggctttttcaatcatttccttcatctcattgatgacatgatcattcgtgctgatgcggcggatgacattcatctcctgctcgctttccagcgccaataacttttcctcaaggtagccgaatgagctctcgaaatcgtgccggagccggtcgattaattcctttccggccagcggggcatatgtaaccggatcagacggcacaatatggacagcgcctttatcaactaatttccccaatacctcatagatcattgagcgggggacgcctgaccttttgctgatttcatatccggtaacaggcgagtgtttcaacaagccgatatatgctttacattcatattgagaaaatccaaacttctgtaattctttcagaacatcatccataaacatcctccgtagtggttattcatgaaactactataatgtaagcggttatatcttgtcaatgggacttgagtgctgaaagaaaggttcgcctgttttgtcgctttccaacttagtttatagtgagttacatgtatggcttttgtgaaaaacgttgccgtagacccacacgaatgccgtttgatacgataaatacaagaagtcaaaaagaggaggatcacggtggaaaacacctctaaaatcgcttttttatcggttataagcaattccctggtcgtcatgctcaaaatagtggtggggatcataaccggatctgtcgcgatactttcggaagccattcattcttttttagatttgatcgccgccttcatcgcctttatctccgtcaggatttcaaaaaagccggctgatacagggcatccgtacggtcatggaaaagtcgagaatctgtcggggaccatcgagacgatgctgatttttgcggcagggatttggatgatatatgaatgcgttcaaaaactggtcaacccggctccggttcatctgcccgtattgggaatcgctgtgatgcttgcgggggctctcattaatttgatcgtttcgaagttcgtaaaaagagaagccgaaaaggttaattccgtggcaatgaaatcgaatgccctgcatttactgactgacgtgtacacatcattaggcgtagcggcaagccttttggtcgttaccttaacggagtggtacatacttgatcccattataggtatggtgctggcggtgtatatcatatatgaagcgtttaagttaatgaaagaagcattcccgccgctgattgatacccgtttgtcggaagaggaagaaaaaacaattttaaagattatcgaaacatttcaacaggaatttattgaaattcacgattttcgtacaagacgctccggcccccaggagtatattgattttcacctggtcgtagcctctcacgtggcgattaaagacgtgcacgacctgtgtgaccgcattgaaagagatattacgaatgaattcaaacaagcacaggtaatgattcaccccgagccggagagcgagaggaagaaataatcgatcttaagtttgcgtttgttcccggcaaaatgtctgcaaaaggcccgtttccacgggtctttttgttgtataaatgactatttctcgctcatatgagagagaagcttatacacgtgaggggtacatttcatacgttatgttgtaaagaaaaagggaggtgaacagaattgaacgctatttctgttaaagaaattgaacatggagttgccgttgcggaaagagaaggtttaggggagtatttataccaagaaccggtttccaaaaaatgttcgcgccgttcccgcagcagaaaacggacacaccgttcccgcagcagaagacggagtcatcaccggacacaccgctcccgcagcagaagacggacgcatcaccggacacaccgttcccgcagcagaagacggacgcatcaccggacacaccgttcccgcagcagaagacggacgcatcgccggacacaccgttcccgcagcagacggtcacatcaaaaacgtacccgcaagcgctgttttaaatgctgaagcagactctattacaagtaatggagatctgctataatggcaagagaactgcataaaagatccggtatcatcatctgcggacactgaactgacaacatggcgctgtttgttcgtgtccgttttttatgtcaaaaaagatgccggaggataaaaaggaagggatgacgccgaatgaagctgaatgaggaattttataactctgaaggaaagacagtctcttcgcaaaacataagcagcaagcttttgcatatcacggacagcgggcatatcagcattgacttcatcagcataagcaggctgcggaaggcttcaaaaatcgcgatcttaggtgacagcgtcgcccgggggctgcgcgcggaatacggctttggtgacattctgaaagaccggacagacgctgaaataaccaatctgtctgtcagcggcgttaatatgagcaacaacggaagcgataacatttatcagcaagcgcttaaaacaaagggacatgatgtcatcattgtccagggaacagatgatgattggtgcaaccacattcccatcggcacagatgaaaaggatatcaccacattttacggaggcttctgtcaagtgattcagcagctgcgaagcggaaataaaggcgcgagcatcattgtggtgaccccaacgagacaagcaaaaatatcaaaaggaaaaatcgtccgccgtgatactgataaaaataaactgggcctgaagctggctgactatgtgaaagcccaaaaagaagcctgcacactcctctctgtaccgtatgccgacctgtttgatacagatctcatcgacccgtataatcccgctttccgcagcatgtgcatgtcagaaggtcttcatccgaacgagaaagggcatcaaatcatttttcaggaaatctgccggaattattattactattacgggtaacacagcgctaacagattattttcggccttgcttttctaaaagctcaattattctttgagatgcgtgtttttgcgctctcaaaagcgaaatgatattaccggtaaaaccgattaaaatgatcagcagcaaaatgatcatccacataagtgaacctcccgtcgagtgttgaaaaacccactctttattttacttattatggatggggaagagaataggtctaactattggtgtttctttatcaatccataaaaaaatgcacagactgaacgggtctgtgcatttttattcgcttatttcagcaggttcaatgattcacgattaaaggcttccaaatcgtcaggcgttctgctcgttacgatgttatggctcacgacgacttcttcatctttataatgtgcgccggcattgattaagtctttgcggatgctgcggaatcccgtgatatcttttcctttaagaaggtcggtatcaatcagcagctgcgggccgtggcagatcgcgaaaacgggtttctgattttccacgaatgatttagtgaattcacccgggcggtcatctccccgcagaagatctggtgaaaagcctccgggaatcaataacgcatcgaattccttggggtctgcgtctgagatcgcttgatcgatctttactttctcaccgtgcttgcccgtcacttctttccctgcttctaaatctattgtcaccacactgtggcccgcttctttaaatgcttccgccgggcttgtatattcaatatcctcaaattgatctgtcatcagaactgcgatttttttgctcatcatcatgcctcctgtgaatttgtatatgacaagaatatcaggcggattgccgcctcacaacgtatttgcttgaagatacggcatgaaaaaagacccctctgaaaaagaggagccaaaaggtacggaggtctgctgaggcaagaaatcgaaccaattactttttgcgtctttttttatcctttttacacccgcatttccccggatcgcccggatcaatgacttcgtgaattgtttcttcctgataaacgtggcggggaacataacggatatgttctctgttaatgtgtttgatgggatggacgtaaaccacttctttgtcagtatacttgtcagtcacaatatacttagggtcacagtaatacactttcgattttttacccattcatctcacctcccgtactttattaaatgctgaaaaggaggattttgcatcggacaagtacactatggaaagtccacaattttccagctgtaatttcgtttttctggtttttcctgaatccgtctcaaattggaatggctaaccctttttgaacggggaaatctataaaaaagaattcaaaaacgattcttttctcaggtcaatcgagatgcatacatctttagggggatttcagaatgctcgatgaaaaaacgattgaaatcattaaaagcacagtgccggtcttagaagagcatggtgaagaaatcacaggccgattttatgacctgctttttcagcatcaccctgagctgctgaatatctttaatcagacgaatcaaaagaaaaaaacacagcgtacggccttgtcgaatgctgtgattgcggccgcagccaatattgaccggctggaaaacatagtccccgtcgttaaacaaatcagccataagcaccggagtatcggtgttaagcccgagcattatccaatcgttggaaagtacttgttaatcgcgataaaggatgtgctaaaagacggggctgctcctgaggtcattcaggcatgggaaaaagcatacggcgtcattgcagacgcttttatcggaattgagaaggacatgtataaacaagcggaaacgcaaaaaggcggctggaaagacgataaggcgtttaaaattgataaaaaggtaaaagaaagcaaagagataacgtcgttttatttaaaaccggaagacggacaagttctccccgaattcaaagcgggacagtatatcagtgtaaaagtatacattccggacacgggttatacgcatatccgccagtacagtttgtcggatgtatccggtaaggattattaccggatttccgtgaaaaaagacggaattgtttcttcatatctgcatgaccaattacacgaaaaggattcaattgagatcagcgctccggccggggatttcgtattagaccctgattccaaaaagaatctggttctcatcagtgccggtgtcggaattaccccgatgatcagcatgttaaagacggttgccaaaacccagccgcagcgaaacgttctctttatccatgcggcaaggagcggagagtatcatgcgctgcggcatgaagctgaagaagccgcggaacactcatccgctgacaccgtctttatttacagcgaaccgtccgaacaagaccgttcagaaaacattcgttttcgggaaggccggattgacaaacagctgttagaagaagtgatgacagataaagatgctgatttttacctgtgcggatccccgtcgttcattaaagaaatgaaaaagctgatttctgaattcaatataacgccggaatccattcactatgaattatttgaaccgcagctgagtatggtgtgatgtaacaacatcttagacagtctgtttaacagactgtctttatatgtttaatacgaaaggttttccccataacatagaattttcaagcaggtaaatcatattcaaagtcgtattatcctaaaaagacaaagttttttatgtcccaacatacttcagtagccggatggaaaggttctcttcctgatacttcaactggaacattggctcctgctcttgtgaataaaatagcaatgctctaataataagaggtggctcaatggcagtttttgttgaaaaaacgctccaaggtctaaaagaattaattgatgaaaaaggccgcttgaacattttagggaatgaaggaacgcttttagaaacagaatgtactttctttaaaggtgcaacagatctggagattgagagttttgagaagaaaataaaagtctcacttcctgaagattataaaacctttttaaaattgcataacggagccagaatatttgatttgttgatttacggtgagaatgtaggtgggggtttgcatattcttgatttagaagagattgaaaagtatatgcaaaatggttttttagagcctcagtttattcctgtcgcacatctgttagacggatgttatttgttaattgacaaaaccaaaatttctacagatccaaactatttatggttccgcggatttattgagtatgaaccaatgaaacttaattttgagatatttttagatcggtatattttgtgtcaaggagcaaatttttgggagtggaatatctataccgctgaaaattattataggactcaccagggtgataaggattaacctttcctacagttgggttggttcatttttgcggttagacttcgatttgaacttttaaaaataggtttaatttgggagacgaaccgattaattggtgtatagatgatttataaaaagcgcagatactctgcgcttttttatttaagtattttccggatcattcgcagcccgtttttggaagaaggataacggaaagcgaggtcgaagcggttcgtttgtttgacgacgctttttttgtgcgtaaatgcgttaaagctgttaaatccgtgatagctgccgatgccgctttctccgacgccgccgaatggcaaatacggtgtcgcgacgtgcattaacgtatcattgacacagccgccgccaaatgacagattctctaaaacagttcgctcgattcctttgtttgttgtgaagacataaagagcgagcggctttgggcgtgattggactttctcgatgacttcatcgatatcgccgtatgtaaacagcggaagaatcggcccgaaaatctcctcctgcattactggagagtcatccttcacttgatctagaatcgtcggcgctattttgtggtgttcaggattaaattgtccgcctgtaagcgggacgccatcattcagaaagctgagcagccgctgatagtggcgttcactgacgattttgccgtactgcggattttgttcaggctgagggccgtaaaattcactgatcgcatgcttcatttcttctatgagcttcgttttgatatcttggtggacaactaaataatccggtgcgatgcaggtttgccctgcatttgtaaatttcccgaagacgatgcgtttggcggcaagctgtatatcagcatccttatggacaatgcagggacttttgccgccgagctccaaggtaacgggaattaattgtttggaggcggcctccataacgatttttcccacggcaacgcttcctgtgaagaaaatatagtcaaagggctgctgtaataaaacagtgctgacgtcgggcccgccctccgccatagcgacataatcactcggaaaaacgctgctgataagtttagaaagaacagcggaaaccgcaggcgtatattctgacggtttgagaacgactgtgtttccggccgcaatggctccaatcaagggtgaaagcgccagctgcaagggataattccaaggcgcaatcaccaaaacgattccatatggctcagggataatcatgcttttcgagcccaggtgagtcagaggcgttttgactcgcttcggtttgacccattttctcagccgcttcatcacaaaactgatttcttccagaacaattccgatttctgtcgtgtacgcctcctgttcggatttgtggagatcctgatagagagcggctgctatatcggcttcttgtgttttgatggcttgtttcagcttttgcaatatgttcagccttgattctagcggtctcgtatgccccgccgcaaaataggctttgtgcttgctgacgatagaggggatgctgttcattccgtctctcctttttgtaagtatgatgattcattatgtaaaaaatcgcttctgcctgtcaaatgattaaggtgagtcagaaaaaataacaaactcatttctgcgtttcggcaggaatttgatgaaaaagagaattctttttgcggcattatctgttgcaggcattatggggttttctaatgtacatgtagttgaaaagccggttggcacataaaaaaaagccccggacaggggcttttttaataaagagagggaacagcccaaaagaaaaaccccggaaacattgtcatcacaacatgtccggggtttaatccaatgctctttaaagagcgttttacttaacgggagtagaactcaacgataagcgcttcgttaatttccggagcaagctcagagcgctctggaagacgagtgaatgtaccttcaagcttttcagcgtcgaaagtaaggtactcaggaacgaagttgtttacttctacagattctttgatgatagaaaggtttcttgatttttcgcgaacaccgattgtttgaccaggttttacttggtaagacggaatgtcaacgcggcttccgtcaacaaggatgtgaccgtggttaactaattggcgagcttgacggcgagtgcgtgcaagaccgagcttgtacacaacgttatcaagacgtgcatctaaaagaatcatgaagttttcgccgtgtttaccagtcatttttgccgctttgtcaaacaatgtgcggaattgacgttcgtttacaccgtacatgtgacgaagtttttgcttttcttgcaattgcaaaccgtattctgatagttttttacgctgtcccggaccgtggggacctggtgcgtaagggcgtttttctaattctttacctgtaccgctaagagagattcctaaacggcgggacagtttccaagatggacctgtatagcgagccataatgtgactcctcctttggttttattttgtggaaaataaaaaccgtctgttcgatccgaccgtgcacattttgttttcatgtatcctcgctccagcagcagagagttacacgatacaccttacagctaaggaacaaaatgcaaacacagaagctgaacaaaaaggctgcaatatttcacacaaagaacattatatgatttttccccgccgccgtcaaccatttctccatgaagagtgccggtttatgatataatgtacaaaaatgagtagtacatgtttaggtgataaaaatgaaaaaacaaacaattgatgaagtgacggcctttcatcagaaaatgctttcttttttcttaacgaaatctgaatccgtctcattatccgactcgctgttatggctggcctcagctctagaatcctgctttacatctctttcattgaccctttcaccggcagaatcaacacgtttcaccataaaaacagaagatgaaccgcattatgctccgctgaaagagagtgacggccgttttatgatcaggaatcagacgtccggcagatccttttatctgcgctcggaaggcgggctgccgatcccggaatcattgcctgagatcgttactcagtttatcaatcaatctgtgagacaaagcgggctgtttgacaaaacgaagcatcagcggaaaattcacagaatgacagaaatgttccattcgcttttggatcaaaatgaggttttggaaaaactgcaggcaagtttgagtacggctttccggtctttccgcttttcactgtttatcacgcaggatcaggatacggacagacagcttcccgcaaaagaattacatatggacggaaaagatgccgacccgtctgccctgaaggtttatttatcggggagactgctcagaaaaggcaggtcatctgcttacctgccgatcaaaggccagcaggggacttacggggttctgaagacggaggggctgcaggatgccgttctttcgtgcagtactctcagtgaaatgctgctgcttgcgggcgcggcgggaaaagcatttgaaaatgcgcagctctatgagcaatcgaaaaaaagcattgcgaatctggagctcattaatgaaacatcgcgccagctgaatcagcgcctcagactcactgacacgatgcgggaactcgccgccattatgacccaatcatttcatgcggaagaagtggctttttttcatattgatcattttgagacgcaaaatctgcttccgggacataccgctttttttaagacagaacgtgcgaacccctatatcagcattgtgaaagaaaagctgttcgagggagaaaagggcgtgtttatcggcagcggaaagactgtattcggcgaaaacggcttcggctcgctgatggcggtgccgatgatcgaaaatgacaccgtcttcgggttcgcgattttattgaaaaaggatttgtatgcttttacgtttgaaatgtataagctttttcaagcgctcattcaccatgcgacattggcggtcacgaactccatgctgcgcgacaggcttgagcatcttgttcagacagaccagctgacggagctgtattcaagaacctatttggatgagaaaattcaatacagcatgaaaattcataaacggggtgtattcatcctcgttgatatcgataatttcaaaaccattaatgatacatacggtcatcaaacgggagattcgatcctgattcaggtggcctccgttatgaaaaaccatattcgtgagcatgatgtcgctgcaaggtgggggggcgaggagctggctgtctatctgccgaatatcaacgtgtcatccggagaacgcatcgctaaaaggctggttcgcgccatccgggaaaacaccgagccgcgcgtgacgatttcctgcggcgtttcctgctggtcaaagacaggcccgatgccgttgaaaatgctcgttcagcaagcggacgaggcgctttatatcgccaaacggaacggcaaaaaccggctgatcatccaccaaaacagcacgacgacataaaaaaggagccggcctgccggccgggctcctttttttatcctaatcgtttttcaagcgtttcaataaactttgctaaataggtttcgtccgtttcatcaaaacggtttttcacagggctgtcaatgtccagcacaccgatcacttcaccgtttacgcggatcgggaggacgatttctgactgggaagccgcgtcacaggcgatatgtcccgggaacgcattcacatcggcaatccgctgcacggcgccgttagagtaggcagtgccgcatacgcctctgccgaacgggatgcgcacacaggcaggaagtccttgaaacggtccgagcacgagctcgccctctttagcgaagtaaaaccccgcccagttgacttcatgtaatgaatggtataaaagcgctgatgcattcgcgtaatttgcgatcgcatccgtttcatcttctgtcatggcttcgagctgtttaagcagaagctgataacttttttctttatctccggattgtttttcgacatgaaacatggaaaaccctcactttttctataatatcaaacaaagttccggccgttctgccggcatttgtcgagaagttcttacaggaacggcgcctttctgcttgaattgttacacataaaggggtgagccgtatgaaagtaagcaccaaagacaaaattattaacgccgctgtccagctgtttaaccaaaaaggttattccggcacgtccgtccgtgaaatcgcaaagtcagctgatgtaaatgttgcgcacatctcctactattttaaagggaaaggcggattaatggaacatttagtttccgagttttacgaaggctatactgaagcgctggaaaaagccgccgtcagtatgaacggtgaagacgcgcaggaacgcatcctgcgggtgattttcgatattttatcctatcagcacgataaccgtcaattaacgcggtttgtgtaccgggaagtgacgattgattccgtgcttatcagggaaattatgtctacttacttaatgaaagaaaaatatattttccagctggtgattgaagaagggcagtcacgccacagacggctgacgctgcccgtgccgcattttattctgcaattgaaatccctcttgatgatgccgtatcttcagcctcaatacattacagaggtgctctatatgcagcctcatgaaccgtacttttataaaaggtattttgaagaggtgaagatctggatcgaaagcgtgttccgacggcctgatgcggcgcttatgaagtaatgatgcttttgtacgtttcataggaactgccgacatcttccgcttgatgggcgtccgacccgaatatgagcgggatttttttttgcttcgccgtctcagccatccaatcctccatgtatacttccccggcaaacttctttctgagcccggatgtattcacatccagctccattccgtgttctttcacggcgtcaagacagcgggccgcaagctctcttatttgaggtgacatgctgtaagggaaaaggcgcgcgaattttttgacgagcgtgatatggccgacccgttttggcttaaaggggccgagcggtgttacaatggaagaatacacagtttcatagtattgttcatatacggcttcaacgcttccgaagtgcgcggcgagctgctgaaaggcgtgctcgtcaaaatcgaggcagatataagacggaccggtcttcaaaaaatgaacggataaaatgccgtcatccagtgaggggccgtacgtgttcagaaacgccgcggtttcctcttcataccctgtgataaaatcagtttctagcccggtcagaatgctgatttgtccatcgtattcctttttcagctgtgacagccgctccaaataaacctccatctgtctgagatccatcgcgctgtcctgaagcggtacgggatcttgaaatgacggaggaaggggggcgtgctctgtaaatgtgatcgagtcaaagcctctttccagggccttttcgacatattctttcagcgcatccttcgagccgtgagggcaaaaaggcgtgtggatatgagcgtctcgtttttccatttgtgtcactccattaaaaaattgcagaatcctgccgaaattatgcaaaaagtttttgatttctggtcaaaaaatgttggttacatggtatcataataacaatgaaaacgacagattttctcaatacatatattgaaatctttctgaatacataaaacaccctgacagattaagagaacaacaagggggctcattatggagttagtcatcggattattggttatactgctcgcgctctttgcggcgggctactttttcaggaaaaaaatttatacggaaattgaccggctggagtcatggaagattgaaattttaaaccgttcgatagtggaagaaatgtccaagatcaaacatctgaaaatgaccggagagacggaagagttctttgaaagatggcgcgaagagtgggatgaaattgtcacagcccatctgccgaaagtagaagagctcctttatgatgccgaagagaacgccgacaaataccggtttaaaaaagcgaatcaggtgcttgtccacatcgacgacctcctcactgcagccgaatcaaatatagaaggcatactgcgtgagatcagcgatcttgtgacgagcgaggaaaaaagccgcggagagattgaacaggtgcgtgagcggtattcaaaagcgcgaaaaaaccttctggcgtacagccatctctacggagagctatataacagcctggagacggatctcgacgaaatctggagcggcataaaaaagttcgaagaagagacggaaagcggcaattacatcaaagcgagaaaagtgctgcttgaacaggaccgcagactggatcagcttcaaacatacatagatgacgttccgaaactgctcgctgactgtaaacagaccgtgcctaaccaaattgccaagctgaaagacggctaccgggaaatgacggaaaaaggctacaaattggagcatattcaaatcgaaaaagagctggagacactcaccaatcaattgaaacgggccgaaagcgcgcttttggaagaattagatgtcgacgaagcgtccgccattcttcagctgattgatgaaaccattcaatcgatgtatgaacagctggaaggcgaagtggaagccggacagtccgtattaagcaaaatgcctgagctgatcatcgcgtatgagaagcttgaggaagaaaaagaccgcacaaaaaccgaaacggagctcgtcaaggaaagctatcagctgacggcgggagaaatcggcagacagcatgctttcgaaaaacagctggaaacgatcggccggctccttgagcaggcgagagaaaagcttgacggtgagcatgtcgcttactctctgctgattgaagaagtcgaggccatcgaaaagcagatggaagaagctcagaaagaacatgccgaataccgtgaaaatctgcaggcgctcagaaaagaagaactgcaggcgcgggaaacgctgatgaatcttcggaaaaccatttctgacacggcccgaatgctgcaaaaaagcaacgtgccgggaattcctgaacaagtcaaggacaagctcgagacggcaaatcatcatatagaagagaccgtcagccaattggaagagctgccgttaaacatggaggaagccgccaaacatctgaccgaagctgaaaaggtggttgcggaagtcagcgaagaggcggaacaacttgtgattcaggtgaagctgattgagcggatcatccagtacggcaaccgtttccgaagccagaatcatattttatccgaacagctgaaagaagcggaacggctgttttacgcttacagctataatgaagcttatgagatggcggcagatgctgttgaaaaagcagctcccggcgccgtgaaaaaaattaaagctgatcaatctgcttcatagacgcacaagcaaaaactgcaccctgatggaaatcagaggtgcagtttttttgtttctcacggaatataaaaagcgcctatggctgatatacatcaaaccgcaggcgctgaatgttacgattttgctttatttaattcgataggcgggctgataaaaaacgtgatgatgcagccgatgatcgctccggcaatgcccggaagcacccagccgattcccatgctgtaaagcggaagatttgcgtttaagaatgaatctaatgatccgagcggaatgccggctgccttcaaaccgtccaggatactgaacagccccgttccgatcaggcaggcgatatagacttcgcgtctttccttaaagattttatcaataaaggaaaggacgataatgacaatcgccagcgggtaaatggctgataaaataggaactgaaaatgcaataatctcagcaagtccgaaatttgaaatcgccagactgaacagcgtgacaatcgtaaccaccattttgtatgataaagcgggaatcaattttgaaaaatattcgccgcaagatgtgacaagcccgatgcttgtcgttaaacacgcaacggtgatggcggcaccgagaacaatgtttcccagtgaaccgaacaggtaatcagatgaagctgataaaatctttgcgccttcgccgagcggcccgacagcgtccgtgcttgtcgctcccaaataggccaaagataaataaatgaatgtcaaacccgccgctgcaatcagacccgctttaatacaagcggccgcgagcgctttacgctgggtgacgcccctgcttttaacagcgttgacgacaacgacgccgaagacgattgaggcgagcgcatccattgttttatagccttccaaaaatcctttgaacaccggcgttccggaatatgcctgatgtacggcgcccagcccgcccatcggagtgacgatggcttttacgacaatgattaaaatgataccgaatttaatgggggtcaaaatttttccgactctgtccacgattttggacgggttaagagctaaataatacgtaatagaaaaaaagatcaacgtgaaaacaaataaagataatctttccggaatgccgcttaaaaacggaactgcaccgatttcatatgaaacggttccggttctcggaatcgcgaaaagcggcccgattgataaataaagcacaacggtgaaaatagtgccgaataccgggtgagccttatcggcaagtcctttcgcgtctttacccgttaatgcgatggcgataatacctaaaagcggcagtcctacgccggtcagtaagaaaccgcccatcgctttccagacattatgccccgccgcttgcccaagctccggcggatatatcatatttcctgccccgaaaaaaagtgcgaagagcatgaaaccgataataacggtatctttgacaggtagtgagtgtttcataaaagtcctcctaaatactatgttgaaatattctgtcaattaattgtcagataatataacaaaacgaacattacttattatatggcaatgtacagagaagtcaatactcgatttattgcgaatttctatttacttttgttatggtagcataaatatcatacgatgtaccgttttcataaaaggagtaaaaaaaaatgatatatttagacaacagctcaacgaccgagccgtatgaagaggttttggaagtgtataaacagacgagcagccgttatttcggcaatccttcgtctctgcaccagttaggaactgagacggagcagctccttgaagcggccgctcagcaaataaaaagaaccttacgtttaaaaaattatgatattgtatttacatcaggcgcgactgaagcgaataacgctgcgttaaagggagcggcctgggcaaacatgagtaaaggaagacatatcattgcttcggcgattgagcatccttctgtgacggagacgcttgatcagctgacagagctgttcggctttgaagtcacatatcttccggccgatcaaaacggcttcgtttctttgaaagacgtcaaatcggctatcaggccggatacgataatcgtcagcgtcatgcatgtcaataacgaagttggctccattcagcccgtaaaggaaatcggcgggtttttgaagcagcaccggaatattctgtttcatgttgatcatgtgcagggcattcataaagttcctctgtctatagaagaagcgggcattgacctttgcactgtttcagggcataagtttcacggcttaaaagggaccggagcgcttatcgtcaaaaaaggaacgcggctcattccgcttataacgggcggctcgcagcaaaaaggcgtccgggccggaacagaacatacggcaggcgccgtttcccttgcgaaagcgatcaatctttccgcgcgtgacatgaatgagcggctttcttccttggaagctgccaagaatgcgctcatggaaaggctgagcggggcggacggggtcgtcatcaacactcccgacgaaaacagcgctccgcatatcattaatttttccgttccgggcgtgaaggccgaagtgctgctgcacatgcttgaggaaaaaggaatatatgtctccacaaccgcggcatgttcggcaagagagcacaaaccgagccgtgttcttctgcaaatgaataaaggcgaacaggttgcatcaagcagcatcagagtcagcctgaacttcagccatacggctgacatcacggagccgtttatggccgcgctggtgccggctgttcaaaaactaaaaaaaatgatgaggtagcatatgaattacgatcatattttaatccgttttggtgaaatatccacaaaaggaaaaaacagacgcagttttattgaaagattaaaacaaaatatccgcctggtattaaaggattataaaaaagtaaaatacttttcaaaccgggaccggatgtcaattacacttaatggagaaaacccggaggaaatttgttccttattaaagaatatattcggcattcaaagtttcagtctcgcaattaaatgcgaaagcaagctggaagacattaaaaaaacggctttagccgcgatagaaggcgaatataaaccggggaatacgtttaaggtcgagaccaaacgggcttacaagcagtttgaattagatacgaatgcgatgaacgctgaaatcggcggccatattttgaaaaacacggatggattaaccgtcgatgtgaaaaatcccgatattccgcttcggattgaaatcagggaggaagcgacattcctgaccattcgtaacgaaaaaggcgccggaggccttcctgtcggttccgcgggtaaagcgatgctgatgctttccggcggttttgacagtccggtcgccggtttttacgcgatgaaacggggattatcagttgaagccgtacatttcttcagtccgccgtatacgagcgaacgggcaaagcagaaagtcatggatctcgcgggatgcctcgcgaagttcggcggcagtatgacgcttcatatcgtgccgtttacaaagacgcaggaactcatccaaaaacaaatcccggaaaactatacgatgacggcgacgcggcgtcttatgctgcaaatcgcggacagaatcagagaagaacgaaaagcgctcgcgatcattacgggagaaagcctcgggcaggtagcgagccagacgcttgaaagcatgtatgcgatcaatgccgtgacggcaacgccggttttgcgccctttaatcggaatggacaaaacagaaatcatcgagaaatcaaaagaaatcggcacttatgaaacaagcattcagccgtttgaggattgctgcaccatctttacgccgccaagtccgaaaacacgtccgaaaaaagaaaaaatcgagcacttcgaaagcttcgttgattttgaaccgctgattgcagaggccgctgccggcatcgaaaccatcactgtttactcagagcaggaagctcacgataagtttgccggcctgttttaaaactgtatacaattaccaaagtttttttgaatgaagacatgtgttttatcacattctatactcacaaggaggtgatacacatgtcacaacaatcaaacagcggaaacagcaaccagcttttagtgccaggcgctgctcaagctatcgaccaaatgaagtatgaaatcgcttctgaattcggtgtaaaccttggaccggaaacaacttctcgcgccaacggttctgtcggtggagaaatcacaaaacgtcttgtctcttttgctcagcaaagcatgggcggaagcagccagcagcagttttaatcacaacttcacataatggctaagagagcggggaattccccgctcttttttcatgagtatagatagaaggctggaagcaatttatgcatatttttattgtaatggcctatgtttatgtataatggggaaagaaagtgaggagttgttcgtgttaaaacgagaagatttaatcgccccaaagaactataaccttgtaaatgaaatcgaaaagttcagccgttccaaagagaagaacgcgcttatttgggaagatcaaacaggcggcaagaaagtctggacgtatgaaaaattgatggaagaaacgaataaaatcggagcccgcctgaaaggtctcggatttgaaaaaggtgataagctgattgtcatggttccgagagtgcttgaagcgtatgccgtttatttagcgatcttaaaagcggggatggtcgtcattccttgctcggaaatgctgcgcgccaaagaccttgaataccggatcaaacacgccgaagtgaaaggcgctatcgtttatccttcatttataaacgcatttgacgaggtgaataccgagcagctggtgacattgtcaatcggtgaaaatgatgccggctggaaaaacctcttaacgattgaagcggacggaaacagttttcaaacagctgatacaacaagagaggacatggcgtttttgtcctatacttcagggacgaccggccagcccaaaggcgttgtacatacacacggctgggcctttgcccatttaaaaacttcagccggtgcatggctggatatttccgaagacgatacagtgtgggccaccgcggcgcccggctggcagaaatgggtgtggagcccgctgctcgccgttctgggaagcggcgcgacaggattcatttatcacggcagattcaacgccaagacgtatttagagctgctggagcgccatcaagtaaatgtcttctgctgtaccccgacggaataccgcctgatggcaaaagtggaggagttggacaaatatgatctttctgcccttcacagcgcagtttctgcgggtgagccattaaaccgggaagtcattgacgtattccggaagcatttcggtattaaagtgagagacggatacggccaaacggagagcaccctgttagtcggcgtcctgaaggatatggatattaagccgggaagcatgggcaaaccgacccccggaaatcaagtagagattataaacgataagggcgaaatatgcgaaacaggcgaaacgggcgatatcgccgtgcatttgagcacaccggccttattcaaggaatattataaagatcccgaaagaacgaaaaagcagattcgcggagattactttcttacaggagaccgcgcgaaaaaagacgaggacggctacttttggtttgagagccgcaatgatgacattatcgtcagctccggatatacaatcgggccttttgaagtagaggacgcgctcgtgaagcatccggaagtgaaagaatgtgcagtcgtggcaagcccggatgaaatcagaggttcaatcgtaaaagcttatgtcgttttacaagacgatgaaaagcgcagtggcgaacttgtcaaagaactgcaaaaccacgtaaaaacgattacggcgccttacaaatatccgagagaaattgaatttgtcgaaagcctgccgaaaacggcgtccgcaaaaatcagacgtgtggaactgagacagcgtgaagaacggctgaaggctgataaaaaagcataatacaggataaagggtgagcggggatgaaagcgatttggcacggcggcaccatctatacaatgcttgacaagaatcatgtcactgaatccgtttataccgaagaaggcgtcgtcaggcagacgggcagctatcgggagctccaaggaacatacggttcgcctgatacggaggaaatcgatttacatggagctgtcatgttcccggggtttacggacagtcatatgcatttaatcggacatggggaaaaacagcttcgcctcgatttgtcgcagctgacgtcaaaagaagcgatcctgcgggccgcaaaagaagcagagcgtgaattggaagatggcgaatggctgatcggcgaaggctgggatgaaaacctgtttgaacggccggattacgtcacgaagcatgaccttgacccgctctttcccgaccgccccgtcctgctgaagcgggtatgccggcacgccgttgcggttaattcagccgcattgcgcgcggcggggattacaaacgaaacacctgatccaaacggcgggattatcgtccgggacggcaccggtccgacaggccttctgctggataaagcccaagagcttgtgacacaggccctgccgcccgtctcacttcactatgtcaaacgcgcgcttcaaacggcgattacggactgctggtcaaaaggcctgacaggcgggcattcagaagatctggcatactacggagacccgtccgttcccgttgccgcgtacgagtctttaaccggcagcggcctttatccttttcgcgcccatctgctcgttcatcacgaagccgtcgacagctggagcgctctggataaatcgaccggaccttacctggaatacggagcgatgaaaatttttgctgacggcgcgctcggaggcagaaccgctctgttgaaaaagccttatcatgatgatccgtcagtttccggcgttcaggtgcacgatgacgagacccttgccgctcttgtttataaagcgagagagaaagggatggagatcgccgtgcacgcgattggcgaccttgcatttgaaaaggtgctcgatgttatcgaaagatacccggcaaagcccggacagctagacaggctcattcatgcgcaagtattagatgccggattgattgaaagagccgcccggctgccgatcggacttgatcttcagccgcattttgtggccagtgactttccgtgggtgattgaccggctcggagaagagcggatgaaaacggctttcgcctggaaaacactgctgtcaaaagggctgctgtgcgccggaggctcagacgccccgattgagccggccgatccgcttctgggcattcaatcggctgtgctccgtacaagcaagcagcatccggaaggtccggcctattatgaaaaagagtgcctgaccgtgtacgaagccattcagctttacacggagggaagcgcggccatcatccataaagaacatagccgcggacggatcgcccccggctatgatgccgactttaccgtactcagcggtgatccgttcgggacggatccgaaaaagcttcatgaattggaagctgtcaaaaccgtcgtcggcggccgtatcgtatatgaaaaagaggacaggcagtgatgcccgtcctctttttttatgataaaaatgatcgctttactttttcccagaaagagttgtctttcagtttcaccgttttgatttttttatcggatagtgtaatctcaacctttttgacattccgcgtgctgagcgcttcattatcaagcccgataatcggatgctcattgccgtcctggaccacctgcagtgtcagcttccggtctgagcttaaaataaacggagatccgagtgtacggtatgtgttgttgttcaacgacgccagttcggatacctgcatgcaggaaatcaaaggatcaacaacggcgcctgagacagacttattgtaggcggtgctgcccgtcggggtggaaatgatcatcccgtctcctctgaacgtctcaaaatgaagatcatcaattaacacatccatcacaaacgttttaataatgcttgaacggatggaaacctcgtttaaacagtgaaaatgattgctgccgtccaccgttacgtgaatgagcgggtattttctgacctcaagctgttccgcggtcatgctggccgccattttttcaggctcatcgctgtgaaaatcacagtacaaatgggctttcccttttttagcgatgccgacatacaggcagtcatcacggaatccggtttttctgacggcttgcagaaatgagccgtcgctgccgatgctggcgataataccggcatcctccgggtgagccgcaactgtaaaaccgtgcgattcagcaagctgcttcaaagagctgacttgttcttttgtttcgttgttttgtttgtgaaaaaaataaacattgcggcgaagatcggtcatatccccattcccctttgctgtcatatttacgtttttctcccagcaggtattgtgttaaaatacctgtggcaatagtgtaacatgtttcctgtttatccgttaagagaaagcgcttcatgaaaaaaatgaatctttttttacgggggaacgtacgaatattgacagaaaaggaggagaacaaatgaatgcaaaaagatggattgcgctcgtcatcgcgctcggcattttcggcgtatcggtcattgcaagtgtgaccgtcggggtgctgaagaatatcggagatacagggtctgactttgcatcactgacagatgacacagaggaagtgacgctggataagggcagccccggcagtaaaatcgccgtgcttgaagtggacggcacgattgaggataacggcgggtccgctggcctgctcagctcaggcgggtatgatcacagatcatttttaaaacaggttgagcgtgcgaaagaagataaaagcgtcaaaggaattgtactgaaaatcaattccccgggcggaggcgtgtacgaaagcgcggaaatacataaaaaactggaagaactaaagaaagaaacgaagaaaccgatttatgtatccatgggctccatggcggcatcgggaggctactatatttcaacggccgccgataaaatctatgcttcaccggaaacgctcacgggttcactgggcgtcatcatggaaagcgtcaattattccaagctcgccgatgaactcggcatcaagtttgaaaccattaaaagcggcgcgcataaagacatcatgtccccgacccgcgacatgacgaaggaagaaagaaagatcatgcagacaatggtcaacgattcttatgaaggatttgtcaatgtcatttcaaaaggccggcacatgtcaaaagcggatgtgaaaaaaattgccgacggccgtgtttacgacggcagacaagcgaaaaaaatcggcctcgttgatgagctcggtttttacgatgatacgatcagcgcgatgaaaaaggaccataaaaatatgaaaaacgcttcagtcatcacatacgaggaaggattcggattaggctcgctcttttccatgagcgcagcgaaaatgtttaaaagcgaaattgattttctgaatatgaaagaactcatttcgcaatccggttcgccgcggatgatgtatctctatgcaaagtaggggggaagaaagaatggacgcgacttacgaaggctttcacggcaaagaagaggaagccgaacaacagagggcgcccgagcaggcatatgcgggcttttggatcaggttttgggcgtttcttcttgattggctggtggtctggggacttaaccatctcatcgtttcaccgattttcacgctgatgaagctcccggcaacaagcggaatgtttacaatctcagcttattccgtcacaaccctgatcgtctacctcgcctattttgtgttcatgacgaaatggtttcatcagacactcggcaagatggtcttcgggttaaaggtcacttctttgacgcccggaaagccgctgacttggagcaccgtcattttcagagaagcggtggggcgttatatcgataaaatctggattctctatatcgtcattgcgtttacgcccaaaaagcagggcattcacgatctgatcgccgacacaacggtgattcacgaagcgctgtaccgcaaataaaagcagtaaacccggaataaacgtccgggtttattttttttggttttggcgataatgctgctaaggaagtgaagcctatgggatatgccgcagcagctgttattctcattctcattttggtctggctgctcatgaggatgaaaatccatctgactttcgaatatcttcacgataaagataacgacaaactgacgtttaaactctcggccttatacgggctggtccgttttaaaaaaacgctgcccgtcattaaagtaaacagcgaagacgcgtctattgatgtcaaacaggacacgaaatcagaaatgaaaggtcagaaaaaagagaagaaaaaaatcacatatgaagatgtcaaacagagcattcacagaatagaaatgattctgcaccaagtcttgcagatgcgccaaatcgccgtctcatttcttgcgggagtccgtgttacgaagtttgaatgggtgacggttatcggaataaaggacgccgccgttacgggaatcgccgccggcggattgtgggccgtaaagggaggccttacggcgatgctgtatgatcatctgcgtttcatacataaaccggtgtgcgaagtcattccgtcttttcaagtgcctgcatccaagacgcatttgcagtgtatattcttttttcgttttggacatcttataggtgcagctttcaaattgctcaaatacgggcggaacggactttctatcatacgaaagaaacagccggttccggttgcttcaaagaatgattcatcagtttaaggaggagcgcatatggcagaccaccccattcaaggtttaatgaaaaccgctatggaaaatttaaaagaaatgattgacgtgaatacaatcatcggcgaccctgttgaaacgcctgacggcagcgtaatcttaacggtttcaaaggtcggattcggatttgcggcgggcggaagcgagtttggaggaaagccggctgaaaaaagaaccgatgatgatgaaagaaaagagcagaagctcccgttcggcggcggaagcggcggcggagtatccattacgccgattgcgtttctgattgtcggaacaaacggcgtgcgtatgcttcatttagacgaaaacacccatctgattgataaactgttagactccgcgcctcaaacgattgaacgcatccagcatatgtttaaaaagaatgaaaaaggccggaaccaaaaaagaacggatatcgatttataacagaaaagttaactgccgcccgcagttagctttttttacgatgcggcataacctttgcagtttgcataaaactcgactatgatagagctatacatagataaagggaggaatcagaatggctgaaattacatttaaaggcggagccgtgacgctgatcggacaagaagtgaaaccgggtgaccaagctcctgacttcacggttttgacaaacggattagaagagaagacattagcagatatgaaagggaaagtaacgatcatatccgttattccttccattgacacaggcgtatgtgatgcgcagacacgccgctttaacgaagaagccgcaaaactcggtgatgtgaacgtttatacaatcagcgccgaccttccgtttgcacaagcgcgctggtgcggagcgaacggaattgataaagtggaaacattatcggatcataaagagatgtcatttggtgaagcattcggtgtttacatcaaagaacttcgtcttttggcgcgttccgtattcgtccttgatcaggacggaaaagtcgtttacgcggaatacgtaagcgaagcgacaaaccacccgaattatgaaaagcctatcgaagctgcaaaagcgttaatcaagtaaagaggggaaaagagctccgggtgctgccgcggagctcttttcatggcaaggaggaaacagcatgcaacacgaccatgtcggtcagatttatgaacttttagatgaagccgcccaagtgatagcagaaggccttgagatttcttatattgaggggcttgcggaggcgggagagatgtattttcttgaaacgacggaccagcttccgcttcaggaaaaacaaaccggcgagcttaaaagcctgcttgcgaaagcagacttcagaaaatgggagcatgaatggatccgcaaggcgttccagctcgccattttaaaaggactgaaagataagtcccatccgaacagacagatgacgcctgatacgatcggccttttcatcagttacctcgtgaataaatttacgggcggccgaaaaggcctgacgttgctggaccccgcctgcggcaccggaaatcttctgctgaccgcggcaaaccagctttctgacaaagcgggaaaaagcttcggcattgaaatcgacgatgtccttctgaagatcgcatatgcgcaggcgaatctgcaggaaaaagaaatggagctgttctgccaggacagtcttcagccgttatttatcgaaccggccgatgcggttatctgcgatttgccggtcggctactatcccaatgacgaaggcgctgaagcgtttgagctgaaagcggatgaaggccactcatttgctcaccacttatttattgagcagagcgtcaaacatacaaaaccgggcggatacttattttttatgattccgaaccatctgtttgacagcgcgcaaagcgataaactgaagcggttttttgcggaaaaagtatatatcaacgccctgcttcagctgccggctactatgtttaaagatgaagcgcaggcaaagagcattttaatcctgcagaaaaaaggcgaagacgcaaagccgccgaaacaagcgcttttggcgaatcttccttcttttgcgaaccagcaggcgatgcgggagatgatggcaaaattggatcagtggattcaaaaagaaaaataatggcgaaaaagcagtgtgagaagcaaaaattccgcgctgcttttcgctttttaaaatgaatggaaatcagggcgaaaacacaaattaaggaaagaaaataacattccgtaaggccgtgccgtccatttggcacaaatgagatttatcagaaaatatcgacttcatattgtaagcggtaccaatgtggatgttgacttgaaatgctgagttgacaatgtttaaatggaaaagtcagatattttttggaccgcagttatggtctgggaaaaaagaacgaacaaacgaagaagaattttgataggagcgtcatttatgtctaaaattattgcaattaacgcaggaagctcatctttaaaatttcagttattcgaaatgccttcagaaaaggtgctaacaaaaggtttagtagaacggatcggtatcgccgacagcgttttcactatctctgttaacggcgaaaaaaatacagaagtgacagatattccggatcatgcggttgcggtgaagatgctgcttcacaagctgactgaattcggtattataaaggatttaaacgaaattgacggaatcggccaccgtgtggttcacggcggagaaaaattcagcgattctgttttgcttacggatgaaacaatccgtgagattgaagagatttcagaacttgcgccgcttcataacccggctaacatcgtcggcattaaagcctttaaagaagtgcttccggatgtgcctgcggttgcagtgtttgatacggcgttccaccaaacgatgcctgagcaatcttacctgtacagccttccgtacgaatactacgagaaatacggcatccgcaaatacggtttccacggcacttctcataaatacgtgacacagcgcgcagctgagcttctcggccgcccgcttgaagatttgcgtctgatttcctgccacctcggtaacggcgcaagtatcgcggccgtagaaggcggaaaatccattgatacgtcaatgggcttcacaccgcttgcgggtgttgcgatgggaacacgttcaggaaacatcgaccctgcattgatcccgtacattatggaaaaaacggatcagacggcagatgaagtattaaatacattaaataaaaagagcggactgcttggcatatccggtttctcaagcgacctccgcgatatcgtagaagcttcaaaagaaggaaacgaaagagcggaaacggctcttgaagtgtttgcaagcagaatccataaatacatcggttcttacgctgcgagaatgagcggcgttgacgcgattattttcactgcgggtatcggtgaaaacagcgttgaagtcagagaacgcgtgcttcgcggcttagaattcatgggtgtatattgggatcctgcgctgaacaacgtgcgcggcgaggaagcgtttatcagctaccctcactctcctgtcaaggtcatcatcattccgactgacgaagaggtcatgatcgcacgtgacgttgtccgtcttgcacagtaatgatcgaaaaaagcacatcctttagggtgtgcttttttattgaatgccccagaatcaaacgttacgatatgtttaatacataaacgatgaggtgaagcaatgagtgtgcatgaacataaacaagaagccccgtcagccgtgcgctgcaaggtgataacagtcagcgacacgagaacgaaagaaaccgacaaaagcgggcgcgtcatgatggatttcatcagagaagctggatttgaaacggtcgcttatgacattgtaaaagatgaaaaagatgaattgcagaaagccgttttatccggctgtatggatgaatatacagatgcggtgctgttaaacggagggacgggcattgccgaaagggatgtcacaattgaagcggtcacgccgctgttttcaaaagaactcccggggttcggcgagctgttccgcatgctgagctatacggaggacatcggctcggccgccattttgtccagagcggcagcgggtgtgatccgaaataccgcagtcttttgcacgcccggctcctcaggcgccgtaaagcttgcaatgagtaaactgattattcctgaactgccccatgtgctccgggaaatccgaaaagatttataaatgtataaaaaggctccgctccgctcaaaaaattgggtggggttttttttataaaaggcttgaaaaaacagaatttacttgttacagtgtatacatacaaaatgcatttttattaattaaaactaatttttatacaaagggagcttttaacatggcagaacaaaaaaaggttgtattggcatactcaggaggtcttgatacttctgtagcgataaaatggctgcaagaacagggatacgatgttgttgcctgctgcttagatgttggggaaggaaaggatttggcattcgttcagcaaaaagcgctggaagttggcgccgtaaattcctatgtgattgatgcgaaagaagaattcgcccgggagtacgcgctcatttctatgcaggcccatacaatgtatgaaggcaagtatccgctcgtatctgcactatcccgtccgttaatcgcgaaaaaactcgttgaagtggcggaaaaggaaaacgcggtggccgtagcgcacggctgcacgggaaaaggaaacgatcaggttcgtttcgaagtatccattaaatcattaaatcctgatctggaggtcattgctccggtccgtgagtggcaatggtcgcgtgaagaagaaattgaatacgccgcaagccgcggcataccgattccgatcaatcttgacagcccgtattccatcgaccagaacctatggggacgcgctaatgaatgcggtatactagaagatccgtgggcggcgccgcctgaaggggcatatgacctgacagcatctcttgaaaacacgccggacgttccggaaatcatcgaaatcgcatttgaagccggtgttccggtttcaatcgacggcgtaacctacccgctcgctgatttaattctcaagctgaacgagactgccggaaaacacggcatcggccggattgaccatgtggaaaaccgcctggtcggcattaagtcccgtgaagtttatgagtgcccgggcgccatgactttgattacggctcacaaagagcttgaggatctgactttagtgaaagaagtggcccatttcaaaccggcaattgaacaaaaactgtctgaaatcatctataacggtttatggttctcgccgttaaaagacgcgctgcttgcattcctgaaagaaacccaaaaacacgtcaccggcgttgtgcgcgtcaagctgtttaaaggccatgccattgtagaaggacgtaagtcggaatattctctctacgacgaaaaacttgcgacatatacaaaagacgatgcgtttgaccatcacgcggcaatcggtttcattgagctttgggggctgccgacaaaagtaaacagcattgtgaaaaagaaggagcagattgaagcatgaagaagctttggggaggccgttttcaaaaaacaccggaaaagtgggtcgatgagttcggcgcatccatcacattcgaccaaaacttagtcaaagaggatattacagggtctctcgctcatgcggcaatgctgaaaaaatgcggcattctgacggaagaagaagaaggtgccatccgtcaagggctgcagactctcctgcaaaaagcagaggaaggaacgcttgaattctctgttgattatgaagatatccatttgaacattgaaaaaatgctgattgaagaaatcggaccgctaggcggcaaactccataccggaagaagccggaacgaccaggtggcgactgacatgcatctatatttgaaagatcatgtctcgcatatcatcgtgctgattgaacagttccaaaaagcgctgatcgaaaaagcggaggccaatgtcgagaccattctgccggggtacactcatttgcagcgggcccagccgatttctttcgcccaccatctgcttgcttatttttggatgcttgaacgggataaagagcgttttcgggatgctatgaagcggattaacatatcgccgctcggatgcggggcgcttgccggaactacgtttccgatagaccgtaactattcggcggagctgctcggttttgactccatttacgagaacagtcttgacggagtcagtgacagagattttattctcgagtttttaagcggcagcagcatgctgatgatgcatctttcacgtttatcagaagaaatcattctatggtgctcgcaggaattcagattcattgaactggatgatacgtacgcgacgggaagcagcatgatgccgcagaagaaaaaccccgacatggcggagctgatccgcggtaaaaccggacgcgtatacggtgatatgatgggtcttttcacaattatgaaaggactcccgctcgcttacaacaaagacctgcaggaagataaagaaggcatgtttgacacagtaaaaaccgttgaaggaagccttcagattttcacgggcatgattgaaacgatgaaagtaaacaaagacatcatgaaacaagcgacaaaacaagatttttcaaacgcgacggaacttgccgattatttagcaaaaaaaggcatgccgttcagagaagcgcatgaagtggtcggcaagcttgtgtacagctgtattgaaaaaggaatctatttaagtgacatggcatttgaagaattccttcaagccagcagtctctttgaagaagatatctataccgtgctcgatccgcatcatgcggttgaaaaaagaatgagcgccggcggaacgggttttcagcaggtagaacaggcgctcgtaaaagcaaaagcctgcgccggcatttaatttgctgaaatttccttcatattttcccgtcatatcagacaccctacatctataaaagatgggaggtagaaggaatgcgcaaagaacaagaccgttacatctatgatgaaaaagaaagtgaagaaacggccaggcttatctcagaggcataccaaagcggttatgtcggcatggaggaagcctctgctccttcagaaaattaagctgtctgtaaagacggcttttttttcgtgcggacgaagtgcaaaaaagtgatattgccgtttgtttatagtaaagtagagggagaaaccttgattttattgaagcggctacgttgcctggggagggtattcaatgtgcgacatgctctaatcactgccggtacaaagggattgggccgaaaagtgactgaaatgcttctggaaaaaggcttttctgtcacagtgaattacagacaggacgaagaagcggtcgcttgtctgaaggcggattatcccgggtgccatgacagattgcaattcgttaagggcgatgtaacccggaaagaagatctcatgcggatcgccgatgcagcccttcagcggtttggaaggattgacatactgattaacaatgccgggccgtacatatttgagcgcaaaaagcttgccgattactccgatgacgaatggtatggcatgcttgaagggaatttaagcgccgttttccatctgtttaaagcggttatcccggtcatgagacagcagcgcttcggccggattattacatacggttttcaaggagcggaccatgcccccggctggcttcaccgttccgctttcggagcggctaaagtcggattggcttcgttaacgaaaaccattgcgattgaagaagccgaatcaggcattacagccaatatggtctgcccgggtgatattgtaggagatatgaaagaagcgtctatagaggaagcaagacggaaaatcggcaaagaaaagacgccgatcggcaggtccggaaccggagaggatattgcgagaatcatcgcgtttttatgtgaagaagattccgatcttgtaaccggaacggtcattgaagcaacaggcgggctgaatgtgattaacaggcatcaatccctgtaagttttttcgtttgtcaaaaagggaacttgataaatattaattttttatgaggtgaaaacgatgaaagtgacttatcacggacattctgtcattcaagtggaaacgaaaacccataacattatttttgatccgtttctgaccggaaacagtctgacaaatttgaaaccggaagaagtgaaagcggatgtcatcctgcttactcacggacacaatgaccatgtcggagatacagagcagatcgccaaacaaaacgatgcgctcgtcattgcgccgaacgagctggccgtttatctcggctttaaaggtttaaaggtccacccgatgcatatcggaggggcgcaccaatttgatttcggcaaagtaaaactgacacaggcgttccacggatcggcggtcactgatgaagaaaacaaaaccatcacatacaccgggatgccggccgggattttattaacgattgacggcaaaacgattttccacgccggcgatacggcgctgttctcagatatgaaactgatcggggaactgaatcacattgacctggcgtttctgccgatcggtgataacttcaccatggggcctgaagatgcgaaactcgcggctgaatggctgagagcgaaacaggtcgttcccgttcattacaatacattccccgtcattgaacaggaccctgacgctttcgctgaaagtctgcccggaggcgtcggcaaagtcatggcggtcggcgagaccattgagcttgcctgacatatgtgtcgaagaccttctgaatcaagcattcagaaggtcttttttgtgatgccgccttttttcgggcgtctcattgcgaatgaatcccccgtacccttataataaaagcagaagactgtccttagaggtgaaacgcttggcaacaaagcatgaacaaatcctatcatacatagattcgcttcctgtcggtgaaaaaatttcggtcagaagaattgcgaaagaaatgaaagtcagtgaaggaacggcttacagagccattaaggaagccgaaaacaaaggattcgtttccactattgaacgtgtggggaccatccggattgaacagaagaaaaaagaaaatattgaaaagctgacatacgccgaggtcgtcaatgtgatcgacggccaggtgctcggcggaaaagccggtctgcataaaacgttgaataagtttgtgatcggggcgatggagcttgacgcgatgatgcgttatacggccgcggggaacctgttaatcgtcgggaaccgaatcaacgcccaccgccaggcgcttgaagcgggcgcggccgttttggtaacaggagggtttaataccgacgacagcattatcgagctggccgatatgcttgagcttccgattctctccacgagctacgatacctttacggtagccgcgatgatcaaccgggcgatctatgatcagctcataaaaaaagagattgtgctcgtggaagatattttgacgcccgcagatcggacagtgacgctgttccctaaggataaactggagaaatggtacgaaaagaactatgaaaccggacacggccgctttccggttatcgatcagcagatgaaaatccacggaatcctcacaccgaaagatatcgcggggcatgaccggtcagttcccattgaaaaagtaatgaccaaaaaccctgtcacggtgatcggaaaaacatctgtcgcctcagcggctcaaatgatggtttgggaaggaattgaagtgcttccggtgacagacgggcatcacaaactgatcggaatgatcagccgccaggatgtcttaaaagcgcttcagatggttcaaaagcagcctcaggtcggagaaaagctggatgatattgtttcaaggggatttaaagaagaggaagataacaaaacgccggccgtttatcaatatgaagtcacgccgcaaatgaccaatcagctcggcacgatttcttacggggtgtttacaacgattttaacccaggccgccagccgatttttacgttcccgcaaacgcggcgagctggtcattgaaagcattacgattttcttcctgaagcccgtacagatggagtcggtcatagaagtgaaaccgcgcattttagaggcgggccggaaattcgggaaaatggaagtggaagtgtcaagccaaagcggcatcgtttcaaaagcgatgctcatggtgcagctgatggagagaagttaagggacacacccgggtcccttggcattcattatgcgtggtccctctccgcttcctttgcatggatgggctcataatgcttataggctttatacccggcccatgcgctgcctgctccgattaaaatgaagacgccgccgatgaccagggtcaggacggagtggaacagaatcatttggtttactccgtacaaaagcaccagcgcgcctaatgccatacttgatttagccgaaaaacattccttctccagcgcccgtttcgtctggattccttttactttgtaatacacgtaaaagcaggcagaaagcccgatgagaaaaacaaaaaccagcataaatgaaatcctccattatatgagtttgcaaaaccgtttataccgttgctgaaagattttccttttccatggataaagagtatgattaaatgaataaaaacgaaaaggagaaaacgatgaaatccgaactgatcagaaccatatcattatatgacaccattatcttacatagacatgtgaggcctgacccggacgcctacggttcacagtgcggccttacggaaatcctgcgggaaacgtatcccgaaaaaaatatttttgccgtcggacagcctgaaccgtccttgtcttttttatattccctcgatgaggtggatgacgaaacctataaagatgctcttgtcatcgtgtgcgacaccgcaaaccaaggcagggtcgacgatcagcgctaccattccggcgcaaagctcatgaaaatagaccaccatccaaatgaagatccgtatggcgatctgttatgggtcgatacgaatgcaagctccgtaagcgaaatgatctatgagctgtacctggaaggaaagcagcacggctggaaactgaatacgaaagcagctgagctgatctacgctggtatcgtcggtgatacggggcgcttcttattcccgaacaccacaaaaaagacattaaaatacgcgggagagctcattgagttcccattttcatcgtcagagctgttcaatcaattgtatgaaacaaaattaaatgtggtgaagcttaacggctttatttatcaaaatgtgtcactgtctgaaaacggcgtcgcttccgttttcattaaaaaagacattttggagacatatggaaccaccgcttctgaagcgtcgcagcttgtcggaacactcggaaatatttcgggtatccgcgcttgggtgtttttcgtagaagaagacgatcaaatcagagtccggttccgttcaaaaggtccggtcatcaacggaattgcccggaaatacaatggcggcggacatccgcttgcggccggcgcatccatcttcagctgggatgaaaccgatcagattcttgctgatctggaagaggtatgtaacgaacacaagtagaggggagaccctctttcttagtgttcatctgtcacggggatgaaccagcagccgaattcagtcaggtcttcgtagacgcggagattacagatttggagttctttttttatgagggaagcgagtgtgtctgtttctgcatatgcggaatagccttgtctgattcgggctgcatgatcttttgccaagcggcgttcactaaaaacctccattttcccttcctcccttcagaatcgttgaaaatgtctcatctacagtttataaaaaagcggagaaaaaagcgacagatctatggaaaatttttaaaaatgacataattacgtcgcaaaagaaatatgaatttcgacagacaatctcgtataaatcgtcagttcctttacttcagctttaaattccttctcatttatggtgtatattttgttttcaatcgtccgttttaaaagctcctttgttttatacacgctttcaatatcctttgtgatgacttcagaaatattatctttcacctgttcctcaaatttcatcttgtcaggctgggcgattctgtatttttcccaattaatcagcttcacatcaacactttggatgagaagtctttgcttattatcctcatttaatttatgaagatctttctgatagatggagatttggttttttaaatcccgcgcgtgctcccgctgcttttcaattaacgtcacctgttcttcctgaaacgttccgtatgtaaacagaaagaacagccagctgatgatggctccgcacatcattcccgcaaaaaaacgctgccatcccggttttttataatactcgggaattctcatgatgacatattctcctgggtcagccatgaaataatcagccagccggtctgcgcgccgcccattgctgaaataattaaaagaagctgtttgaagatgtcgcgcgtgttgccttcaaacagcccccgctcgaaactgtataccgcgtcaaatgttcccccgatggccgcgacaagcgcccagatcttcagcctgttcgccaattttgtgatcgccgtcagcggaggctcgcctgataaataagctccgaggccgccgatcagcgcgccgccgagcaacacaccgagggcgataaaataactgctgatgaaattcgccataaagccggcttcctgatccatatatacaccacctcacttttctatcatattgagcgaaacggacaagtatgatgatgagtcaaaaaagaacatttgtttcttaagaaaacccgtcttataatgtagaaagacaaaatgaacgtatgggaaaggagtggcggcattgtcttttgttcacctgcaagtacatagcggctacagcctgttaaacagcgccgcttctgtaaaagagcttgttacacaagcgaaggaactcggatattcatcattggcgctgacggacgaaaatgtgatgtacggcgccattgagttttataaagcatgcaaatcaaacggaattaagccgattatcggtctgacggcttctatatacacggacgatacggagcttgaagcacacccgctcattcttttagcggagacaaacaccggttatcagaacctggtgaaaatctcaagtgcgctgcaatccatggcaaagggcggcatgaagcgaaaatggatgaagagctatcatgaggggctgatcgccattacgcccggtgaaaacgggtacattgaaagcctgcttcaagccgggaagtttgaagaagcggtccgggctgccgaaggattccgggagctgttcggagacggccgtttttatttagggtaccagccgtttaaaggacatgagacgttatcagaagagattctccgcctgtcagccgagacggaaatcgctgtctgcgctgcgggggatgtccgctatatcaagaaagaagatcaagatgcgtaccgctgtctgtgcgctattaaagccggagagaaatgggaggatcagagcgggaatctgccggacttatacttgaggacgcctgaagaaatggcagagctttacacgcggcatccggaagcgattgaagcggccgcccgtatcgcccggcaatgccgggtcgatgtcagcctcggacagacacagcttccgtcttttccggcgccggacggcaaatcagccgatgactatttggcggaagtctgtcacgaggggctgcgcctccgtttcggcactcctgatgagcgcgctgtccgccggcttgaatatgagctggacgtcatcaggcgcatgaaattcagtgattattttctcatcgtatgggactttatgaagtacgcgcatgaaaagggtattgtgacaggcccgggaagggggtccgcggcaggctcgcttgtcgcttactcgcttttcattaccgacgtggatccgcttaaacattctctgctgtttgagagatttcttaatcccgagcggatcagcatgccggatattgatatcgatttccctgatacgagaagggatgaggtcattcagtatgtgcaaaataagtacggggccatgcacgtcgcccagattatcaccttcgggacattggccgcaaaggcggcgttaagggataccgggagagtgttcggaatcagcccgaaagaagccgaccagcttgcccgcctgatcccgtcgaaaccgggaatgacgcttgaggaggcaaggcggcagtccgctcagctgaacaggcggctgtccgaatccgccgttcttcataaagtgtttcagatcgcaaggaaaatcgaaggtcttccgagacacacgtcaacacacgcggccggggtcgttctcagtaaagagccgctttcggaagttgtccctcttcaagaagggcatgacggcgtgtatttaacgcagtatgcgatggatcacctggaagatctcggtcttttgaaaatggactttttaggtttgcgcaacctgacgcttattgaatccattaaaacgatgattgaaaaagagacgaatacgaaaattgatttttccgagatttcttatcaggatgaaaaaacgttctcgctattgtcaaacggtgatacgacgggtattttccagctggaatcatcaggaatgagaaacgtgctgaagcgcctgaagccgtcaagactggaagacattgtcgcggttaacgcgctttacaggccgggaccgatggaaaatattccgttatttatcgatcggaagcacggacgggcgcgtgtggaagtgccgcacgaggacgtaagaaatattctcagtgacacttacggcgtcatcgtctatcaagaacagataatgatgatcgcctcgcgcatggcagggttttcattaggtgaagcggatctgctcagacgggctgtcagcaaaaagcaaaaggacattctggacagagagcgaagccattttgttgaagggtgcttaaaaaaggagtattctgtagtcactgcaaacgaggtctacgatctgattgtaaaattcgctaactacggattcaacagaagccatgctgtcgcatacagcatgatcggctatcagctcgcctatttaaaggcgcattatccgctatattttatgtgcgggctgttgacgagcgtcatcggcaatgaggacaaaatatcgcaatatctgcatgaagcgaaggggagcgggattcaagtccttccgccgtcaataaacaaaagcggttttccgtttgcgccggaaaacggagccgtcagatacagtttgcgggccgttaaaaacgtaggcgtctcggcagtgaaagatatttataaagcaagaacacataaaccgttcgaggatcttttcgatttctgctttcgcgtacctgcaaaaagcgtgaatcggaaaaccatcgaagcccttatattttctggcgccatggacgaattcaatcaaaatcgcgccgccttgctggcctccgttgatgtggctttagagcacgctgaactttttcgtgcagacgatgaccaaatgggattgtttttggaagaatcgttttccattaagccaaaatatgtagaggctgaggaatttccgctcgtggacaagcttcggttcgaaaaagaagctctcggtgtttatttctcaagccatcctttgtctgctttcagggatctcctgaaaaaacggggggcgcaaacgatcacagcagcgcggcagatgccgaagggacagctgtcaatcggcgctttgctcgcgggcattaaaacgattcggacaaagacaggtcagcatatggcgtttctcacattaagcgatgaaacgggagaaatggaagccgtcgtgtttcctgaccaatatagaaggctgtctccgctgttaaaagaaggcgcgcttttattcgccgccggaaaaatggaagagcgtcaggagaagacacaattcatcatgtcatccgcctctcttcttgaacagacggagacagacagagcgccgtctgtttacatcaaaatcgaaggcagccggcacaatcaggagtttttggaaaagatgaagcgtattttactggagcataaaggggaaaccggcgtttatctatattatgaaaaagacaagcagacgatcaggctgccggatacttttcatattcaggcggaccatcaggcgttataccgtttaaaagagctgctgggccgcgaaaacgtcgtgttaaaatagtggtaacaataatcgttttgttatacaattgaaacaattgtgctatcttatttaaagattctgaaatttttcacctccagcgattgtaccagtctatgcggcagaatatgtaacaaagtacttaaaaggagtgtttagaatgtcattaagagaagaagcgttacatttacacaaagtaaatcaaggaaagctggaatcaaaagcaaaggtagaagtcagaaacgcggacgacttaagccttgcctactctcccggagtagctgagccttgtaaagagatttatgacgataaaaataaagtatatgattatacaatgaaggggaacatggtagcagtcgtaacagacggatcagccgttctcggtctcggtaatatcgggcctgaagcttcacttccggtcatggaagggaaagcggtgctgttcaaaagtttcgcgggcgtggatgcattcccgatcgcgcttgacacaaacgatgtggacaaaatcattgacactgtgaagctgcttgaaccgacattcggaggtgtcaaccttgaagatattgcggcgccgaactgcttcattatcgaagagcgcctgaaaaaagaaacaaacattccggttttccacgatgatcagcacggcactgccatcgtaaccgttgccggacttgtaaacgcgctgaaattatcaggaaaatccatgtcatccattaaagttgtggcaaacggagcgggagcggcaggcatcgcgatcattaagcttctttaccatttcggcgtacgcgacatcgtgatgtgcgactctaaaggagcgatttacgaagggcgtccggccggcatgaacgcggtgaaaaacgaagtggccaagtttacaaaccaagaccgcaacgatggctcgctgcaggatgtcattaaagatgcagacgtctttatcggcgtatcagtcgaaggcgcgctgacgaaagaaatggtggagagcatggcgaaagatccgattatcttcgcaatggccaacccgaatccggaaatcatgcctgaagacgcgcgcgcagccggcgctagcgtaatcggaacaggccgttctgatttcccgaaccaggttaacaacgtgctggcattccctggaattttccgcggggcgcttgacgttcgcgcgactcacatcaacgaagaaatgaaaattgctgcggttgaagcgattgcttcccttgtttcagaggaagaattaagcgctgattatgtcatcccggctccgtttgacaaacgcgtggctcctgccgttgcgaaagctgttgcgaaagcagcgatggaaacgggcgtcgccagaattacggtcgatcctgaagaagtggctgaaaaaacaagacagctcacagtcatcggggaataataacacaaaaatgaaatggcagcgcgttggaaaaaacaacgcgctgctgttcaatatacggactgctggcatttttttaagggcaggtcttaaaaaaatttcagcagaatccttatttcttttgaaaacgctgacagataaggctgaacaacgctttttacggtatgaaatccgtccgtttccgtctgttttgcagcaaaaaatgtcgaatggaggatgacaccgtttgacaaaaaaagtacaatagtttcggtaaagttattattaagtctatctaatcggaagacatgcagtgaagagaacccttcacaaaagggaggtaatcatttgttaaaggatatattcacaaaaaagaaaaaatatgcttccgtgccgtctgagcaggcaaaacatgatgttccggaaggcattatgacaaagtgccccaaatgtaaaaaaatcatgctcacaaaagagttagataaaaacctgcgcgtctgcatgaactgcgggcaccatttcccgatgaatgcaaagcagcgcattgaaagcctcctggatgaagattcattcgaagaattcaaccagggaatgatatctgaaaacccgctcggtttcccggaatacttagaaaaaatcgaaaaagaccgtgagaaaacatcgctgaatgaagcggtggttaccggaaaaggaaccatcagcggattccctgccgtgatcgcgatcatggattcaacattccgaatgggcagcatgggttcggttgtcggcgaaaaaatcacgcttgcaattgaaaaagcaaaagaggaaaaagtcccgtttatcatctttaccgcttccggcggcgcacgtatgcaggaaggggtcttaagtcttatgcaaatggcaaagacaagctctgcattaaaactgttcagtgaggagcagggactgattatttctgtcatgacccacccgacgacaggcggcgtatcggccagtttcgcgtctctcggtgattataatttcgctgaaccgggcgccttgatcggatttgcaggaagacgtattattgaacagacgatcggggaaaaactgccggaagatttccagacggcggaatttttattaaagcacggccagcttgatgcggtgattcaccgaaacgacatgaaagagaaactcgcatttctgctggacatgcaccaaacaggaggtgagcatgagtggctgcaagattagaatttgaaaaaccggtgattgaactgcagacgaaaattgccgaactgaaaaaattcacccaagattcggagatggatttaagcgctgaaatcgcaaggcttgaagaccggctcagcaagctccaggatgagatttataaaaatctgaagccgtgggacagagtgcagatcgcacgccttcccgaccggccgacgacgcttgattacattcaatacctgtttaccgacttttttgagtgtcacggagacagaacatacggagatgatgctgcgattgtcggcggagtcgccaaatatcacggcatgccggtcaccgtcatcggacatcagcgcggaaaagacacgaaagaaaaccttgtccgcaatttcgggatgcctcaccctgagggctaccgcaaagcgcttcgtctcatgaagcaggcggataagttcaaccgcccgattatctgcttcatcgacacgaaaggagcgtacccgggtaaagcggcggaggaacggggacaaagtgaagccatcgccaagaacctgttcgagatggccggcctgacagtgcctgtcgtttgtatcgtcatcggggaaggcggcagcggaggcgcgcttgcgttaggtgtgggcaaccgcatgctgatgcttgagaactcgacgtattccgttatttctcctgaaggagccgcgtccattttgtggaaagactccagccttgcgaaaaaagcggccgaaaccatgaagattactgcgcccgatttattagaattaggaattattgatgatatgattaaagaagtgaagggcggagctcaccatgatatcaagcagcaggcgggctacattgacggtattcttaaagaaacgttaaaatctcttcttcgattgaacgccgaagagttgatctcacagcgctatgaaaaatataaagcaatcgggaaagtttcggttgaggatcaatatatcggggtaaactgaatagacgtgaagcctatggctcacgtttattttttgtgatttttgtgatattccttaaattttatttaaaaacaatttatttaattgtataataggtaaggtttcatgggagctcaggcgtcccttttcattgttttagggcaatgatcatgatatgtttaacatatatagttgctgaggtgaataggaaatgaagcgtataggagttttaacgagcggcggggattccccgggtatgaacgctgcggtgcgcgcggttgtgcggaaagctatctaccacgacgtcgaagtgtacggaatttataacggttattcaggattaatcagcggaaaaatagaaaaactggagctgggttcggtcggtgacatcatccaccgcggcggaacaaagctgtatacggccagatgtcctgaattcaaaacagttgaaggccgtgaaaaaggaatcgaaaatttaaagaaactcggcattgaaggtcttgtcgtcatcggcggagacggttcatacatgggtgcgaaaaaattaacggaacacgggtttccgtgtgtaggtgtaccgggtacgatagataatgacatcccgggaactgattttacgatcggatttgatacggcgttaaacaccgtaattgatgcgattgataaaatccgtgacaccgctacgtctcatgagcgtacatacgttattgaagtgatggggcgccatgcgggcgacattgctttatgggcaggtcttgcaggcggagcggaatcaatcttaattcctgaagcggactacgatatggaggaaattatcggccgtttgaagagagggcacgaccgcggcaaaaaacacagtatcatcatcgttgcagaaggggtaggcagcggggttgaattcggaaaacgcatcgaagaagaaacgaaccttgaaacacgggtatccgttttagggcacatccagcgcggcggatctccaagcgcttctgaccgggttcttgcaagccgcctcggcgcttacgcggttgagcttctgcttaaaggaaaaggcggacgctgcgtaggtatacaaaacaacaagcttgtagaccatgatattatagaaattttagaatcaaaacatactgttgaaccaaacatgtatcagctttcaaaagaactgtctatttaaggcggaagaagctgaagatttcagaaggaagtgaacgagttgaaaaaaacaaaaatcgtttgtacaatcggtccggccagtgaaagtgtagaaatgctgacaaaattgatggaagcgggtatgaacgttgctcgtctgaatttttcacacggtgatttcgaagagcacggcgcaagaatcaaaaacatcagagaagccagcaaaaagctcggcaaaaacgtggggattctcctcgatacgaaaggtccggaaatccgcacgcacgatatggaaaacggcgcgcttgagcttcaggcgggaaatgaaattatcgtttctacgaaacaggtgctgggaacgcttgaaaaattctcagtttcttatgaaggcctggcagacgacgtgtcagcagggtctatcatcctgctggatgacggtttaatcggattggaagtgctggaatcaaatccggaaaaacacgaaatcaaaacaaaaatcttaaacagcggcacgctgaaaaataaaaaaggcgtaaacgttcccggcgtcagcgtcaaccttcccggaattactgaaaaagacgccaaagacatcatattcggtatcgagcaaggcgttgatttcatcgctgcgtcatttgtacgccgttctacggatgtcctggaaatccgcgaactgcttgaagagcataacgcgtctgacattcaaatcattcctaagatcgagaaccaggaaggcgtggacaacctggatgcgatcctggaagtatctgacggcctaatggtagcgcgcggagacctcggcgtagagattccggccgaagaagtgccgctcgtgcaaaaagaaatgatcaaaaaatgcaacgcgctgggcaaaccggttattactgcgacacaaatgctagacagcatgcagcgcaaccctcgtccgacacgtgctgaagcaagtgacgttgccaacgccattttcgacggcacagatgcgatcatgctttccggtgagacggctgcgggacaatatcctgttgaggcggttcaaacaatgtttaacatcgccacacgcacggaagaatctctgaactataaagaaattctgtctaaacgcagagatcaggtcggcatgacgattactgatgcgatcggccaatcagttgcgcacacggcgatcaatctgagtgcggcagctatcgtgacgcctacagaaagcggccatacggcgcgtatgatcgcgaaataccgtccgcaggctccgattgtagccgttacggttaatgagtctgtatcacgcaaactcggccttgtattcggtgtattcccgtcaagcggccaaaacgcgaattctacagatgaaatgcttgaagacgcggttcaaaaatcacttgacagcggcatcgtgaaacgcggtgatctgattgtcattacagcaggttctgtcggtgaatcaggcacgacgaatctgatgaaagtccacactgtcggcagcattatcgcgaaagggcaaggcatcggacgcaaatctgcattcggtccggtcgttgttgcaaaaaatgcgaaagaagctgaacaaaaaatgacagacggcgcagtattggttgcttcaagcactgaccgcgacatgatcgcttcacttgaaaaagcatcagcgctcatcactgaagaaggcggtctgacaagccatgcagccgttgtcggtttaagcttgggcattccggttatcgtcggccttgagaacgcaacttcagttttaacagaaggacaggttatcacagttgacgctgcccgcggcgctgtgtatgaaggccgcgcaagcgttctttaaacagctttaaaaaagagaggggggttctcccttctcttttgtctttaggttgattttcctattcccatgcgggcggtgacgcgcttttagaagggcaggagggcagaaaaatgagagtgttattcttactgtttatcgtatgtccggcaattgaaatcggtttgtttctgctggcgggaaaatggctcggtatttttccgaccttccttctcatcattttgacaggcgtgttaggcgctttggtggcaaaaagacagggaaccgatgtgtatcatcgggtgatgcgcgacctgcagcacggcaaaatgccgggggaagcgcttcttgacggaatatgcgtctttttcggaggcctgcttttgatgcttccgggttttctgtccgatattgcaggggcctgtcttctgattccgttcactcggaaccgcatgaagccgtttttgttcaaatggctgagagggatgtcaaaaaacaagcggatcattatcaaataaaaaacggcagccttcttacagggctgctgtttttatttggattgaacagtaatataggcccatatttcttttagagcgcccgttgtgataaaggcctgaatgaaaacgagcagcgcgggcccggcagccagtcctaaaattccgaacaatttaaagccggcaaacagggcgattaaggtcgcaagcggatcaagtccgattgacttgcttaaaattttcggctccgtcagctggcgctgaatgagaaccacaatatataaaacaccgagaccgatcgcttgaggaagctgaccggcaatggccaaatacataatccagggaacaaagaccgacccggcgccgagatacgggagcagatcaaccaggccgataaaaaaggcgatggttgccgcatgctcaatccctaaaagaaaaagtccgataaagacaatgatcatcgtgaaaagtatgagcacggcctgcgccttaatgaaacctgccatcgcttttttcagctctcccgatacggccttggcgtttgccgaaacccgttccggaaaaatggaataaagcagcgccttcagcttatgccagtcctttgtcataaaaaaagtcgccagcattgcgaaaatgaagacggcagctgtattgggaaggaaggcaatccatttcggcaccagctccaaaagatgtgaaagcatgagccccgcatttttagcggctgtatcaccgagggtctgaatatgcgtcacgatggaagcctgctgattggtttccagcccgttaaataggacggtcagctcgtggtacaatggctgaatgcgggaagtgaacagctcttcgcaatacgtcataaaggcgctgatatggggagggagcgttttggccagataggcggttcccgaaatgatttccgcaacgagaaatgttgccgcgccgagaagaataagcaaaaagaagaccaggacaatgactgtattgactgaccggggcagccccgtcagtttgtccagccagtcaacaacgggaatgatcgctgatgacagaataagggcgatcagaaacggataagttaacggaaatgaggcgtaaccggccgctaaagcgccgccggccgcagcgagtacaaacagcgcgcggaaaaaaacagttgcatagtgcggattcacatcgatcctcctctcggtcggcacgtcctattacattagtttattcgtcaaaaaaaaggatatgattacagatatgatgaaagagggtgctttcaggatgtttacacaggcgaatttatttttactattattgctggccatcgcattggtagccaaaaatcagtcattgctttttgccgtcggctttctcattgtgataaaagctgtcggtcttgatcagaaactatttccggttattcagtcaaaaggcatcaactggggggtcaccgtcattacaatcgccgttttagtgccgattgccacaggtgatatcggttttaaacagctcggagaagcgatgaaatcatattatgcgtggatcgctctcggtgccgggatcgcggttgccttaatcgccaaaaacggtctcaccttattggaaaacgaccctcatattacaacggcgctggtcatcggcacgatacttgccgtcgcgcttttcggaggcgtcgccgtcggcccgttaatcggcgccggaatcgcctacttggccatgcaaatcgttaaaatattcacttcataaagtaaaaaagcggcgtaaagctgcttttttttgcgggtgaaaataagagtttgcagggcattttgtagttcagacaaatgccatttgcattattccgaggaatgaagtggcttaccatgtaacaaagaacttcggaatcgccggcgcatattgtgcgatgacagcggatgcagtaaggcggttccaattgatgaatggattaaaagctgatggaatttatgcacttgaaccaaatcaaaacttgaagtgttgttaaaataagcggagaccctttccttcaatttgaaagtttgttaaatttataatgagaatgaaaaaacacaattcggttggtagtccggatgcattatttaaaatgtcagtaaccttcccctcctcgggatgtccatcattcttcagtaaatttaggaggagggaatcgttatgaaattaacggtttactacgatggtcagttttgggtaggagtcattgaagttgtgaatgatgggaaattaagagcagttcgtcatttgtttggaaaagagcccaaggattcagaaatcatgcattttgttcataatcaacttttacagactctctcccgcactgaacaaacaggggtttgtgttaaagcaaaatctaagaagttaaacccaaaaagattacaacggcaagcttctaaagagatgaaaaatatcaggatatcaactaaggcgcaaaaagcgataaaacaggagcttgaagcaagaaaagaaaagaaaaaacaactgaacagaaaacaaagagaaaaaataaaggaacaaaaatatttaatcagaaaacaaaaagcaaaagaaaagcataggggcaaatagttggagaacccgaagcccttcgattaaaaagttgagcggcatcagttttttcttcggactgatttagaaaaaagaagcagaaatcgagcccttctcgagatgaggagggtttttctgcatttatttaacttcacctacatcagtaaatgagtcagtttcaattgatgaacggtttgatgaggatatttacgggccgacaacagcgcaaatgcagtcaaacgattccagtccatgtacggggagccaactaaaaccaagacatggatttccgaagctgatccgaacattgattcagtcgagtaaacaaaatccccccttctccggtaaagaaggagggatttgcggtgaagttgttgcgcctgtccttttaaagtttccccaaagctccccccaaatgaaaacatgagaatacatggttttacaaagcatctgaaagcaagcgattaaatttatcaacgccaagccttgatatatagggcttttaaaacatttttagttaaaagtctacaaattaatcagattattgtttataataagaataggcttaaacttaaataagcttataagaatttgttatgttcctctataagcataccggttatgtaaccgcaaccagtgaaatgtaagcattttcttaaaggggaaagggattgtttgcatgactcattttaagtaagccgtatgttttatatactctttaaaggggaattttgattgaaaaggagaggttgaatatgacagcaacacgcggtcttgaaggggttgtagcaacaacatcatctgtaagctctattatcgacgatacccttacatatgtagggtacgatattgacgacttgacagagaatgcaagttttgaagaaatcatttatttgctgtggcatctgcgcctgccgaataaaacggaacttgctgaactgaaaaaacagcttgcgaaagaagctgccgttccacaagaaatcattgagcacttcaaatcctatcccctcaataacgtacatccaatggctgcgctccggacggcgatttcattactcggtctgactgacagtgaagccgatgtcatgaatccggaagcgaactacagaaaagccatccgtctgcaggcgaaagtgccgggcattgtcgccgctttctcaagaatccgcaaaggacttgatcctgttgaaccgaaggaagagtacggaatcgcggagaacttcctttacaccttaaacggtgaagagccttctccgatcgaagtggaagcgtttaacaaagcgctcattcttcatgcggatcatgagctgaatgcatcaacatttacggcgagagtatgtgtcgccaccttatctgatatttactcaggcatcactgccgcaatcggcgctttaaaaggaccgcttcacggcggagccaatgaagccgtcatgaaaatgctgacagaaatcggcgaagtggaaaacgccgagccttatatccgcagcaaaatggagaaaaaggaaaaagtaatgggcttcggacaccgtgtgtataagcatggagacccgcgcgccaaacacttaaaagaaatgagcaaacgcctgaccaatctgacgggtgaaagcaaatggtacgagatgtcaatccgtgtcgaagaaatcgtgacgtcggagaaaaaacttccgcctaacgttgatttctattccgcatctgtataccacagtctcggcattgatcacgatctgttcacgccgatctttgcggtcagcagaatgtcaggatggatcgcccatattcttgaacaatacgataacaaccgcctcatccgcccgcgcgctgattacacgggtccggataagcagacttttgttccgcttgatgaaagagcctgatcaaacgggaggctggtgattttcatgtcgttagcctcttgttaatcaagcccggattggtttacaattttgatagaatcttgagaaaagtcattttattttttatacaagaaaaataaaatgttttctaaatatgaattacatactgggaggtaatattgtgtcacaaggtgaaaaaattacagtctctaatggagtattaaacgtaccaaataatccgattatcccgtttattgaaggcgacggcacaggccctgatatttggaatgccgcttctaaagtattggaagccgctgttgaaaaagcatataaaggcgagaaaaaaatcacgtggaaagaagtttatgccggtgaaaaggcttataataaaacaggtgagtggcttcctgccgaaacactggaagacatcagagagtacttcatcgccatcaaaggtcctctgacgacgccggtcggcggcggtatccgttctctgaacgtggcgctgagacaggagcttgatttgtttacgtgcctgcgccctgtcagatatttcacgggagtgccttctccggtcaaacgtcctgaagatacggatatggtcattttccgcgagaatacggaagatatttacgccggaattgagtatgcgaaaggttctgaagaagttgaaaagctgatcagcttcctgcaaaatgaaatgggcgttaacaaaatccgtttccctgaaacgtcaggaatcgggatcaagcctgtttctgaagaaggcacaagccgcttagtcagagctgccattgagtatgcgatcgaaaacggccgtaagtctgtcacgcttgtccacaaaggaaatattatgaagttcactgaaggggcatttaaaaactggggctacgagcttgccgaaagagaatacggagataaagtattcacttgggctgaatatgaccgcattgtcgaaaaagacggaaaagaagcggctgataaagcgcagagcgaagcggaagcggcaggaaaaatcatcgtcaaagacagcatcgctgatattttccttcagcagatcttgacccgtccgagcgaattcgacgtcgtggcgacaatgaacttaaacggagactatatctctgatgcgcttgccgctcaggtaggcggaatcggaatcgcgccgggagcgaacatcaactatgaaacagggcatgcgattttcgaagcgactcacggaacggctcctaaatatgccggccttgacaaggtcaacccgtcatccgtcattctttcaggagtgcttcttcttgaacacctgaactggaatgaggctgctgacttgatcattaaatctatggaaaaaacgattgcttcaaaagtagtaacgtacgattttgctagattaatggacggtgcaactgaagtgaaatgttcagagttcggtgaagagctcatcaaaaacatggactgaacctaaagcagacttctaatgaagccaaaaaaggagaagagaatcatgggaaaaacacgcagtaaagtttctgttatcggagcaggatttacgggagcgacaacagcctttcttacagctcaaaaagagcttgcggacgttgtgctcgttgatattccgcaattagaaaacccgacaaaaggaaaagcgctagacatgctcgaagcaagtccggttcaaggatttgacgcgaaaatcacaggcacgtccaactacgaggacacagccggttctgatatcgtcgtcatcacagccggaattgcgagaaaaccaggcatgagccgtgatgatctcgtatctacaaacgaaaaaatcatgagaagcgtcacacgtgagatcgtgaaatattctcctgactgcattatcgttgtattgacaaaccctgttgatgcgatgacatatgcggtgtacaaagagtcaggcttcccgaaagaacgcgtcatcggacaatccggagtgcttgacactgcgcgattcagaacattcgtcgctgaagaattaaacctgtctgtaaaagatgtgaccggttttgttcttggcggacacggtgacgacatggttcctctcgtccgttattcctatgcgggcggcattccgcttgaaacgcttatcccgaaagaacgtcttgatgcgattgtagaacgcacaagaaaaggcggcggggaaatcgtcaaccttctcggaaacggaagcgcctactacgcgcctgctgcatcactgactgaaatggtagaagccattttgaaagatcagcgccgcgtgcttccgaccatcgcttacttagaaggcgaatacggtcatgaaggcatttacttaggcgtaccgacgattatcggaggaaacggcctggagcaaatcatcgagcttgaactgacagactatgaaaaagcgcagctgagtaaatcagttgaatctgtcaaaaacgtgatgaaagtattgtcataagaaaaaagggaaggcttccgaatcagaagccttcctctttttacaattaatgaaagcgttttctttttccctgagcgatcctttctctgaaaatgatcaaaaaggcgaattgtctgaacgggcagtattggataaaatgaaatcataaagtgatatgcagcacataaaatagagaaaattggatgtcggggaaaatagacagcggagggcgcagcatgaacaaaaaaattttagttgtagatgatgaacaatctatcgttactcttttacagtataatctggaacggtccggctatgatgtcataaccgcatcagacggcgaagaggctctggagctggcagagaatgaaaatccggatttaatcgtactggatgtcatgctgccgaaagtggacggaatcgacgtctgtaaacagctcagacagcagaaaatgatggttccgatcttgatgctgacagcaaaagatgaggaatttgataaggtgctgggactggagctcggagcggatgattacatgacaaagccgttcagtccgcgggaagtcactgcgcgggtgaaagccattttaagaagggctgacatttcttcgctgtcacaaggcagagaagaggaaaaggacgggcagatcctcatcggcgagctgaaaattcttccggagcattacgaagcgtacttcaagtcagaacagctggaattgacgcctaaagaatttgaactgcttctgtatttgggaaaacacaagggaagagtgctgacgagagatcttctgctgagcgcggtctggaactatgattttgccggggatacccggattgttgacgttcatatcagccatctgcgcgacaaaatcgaatcaaataccaaaaaacccatctatattaaaacaatcagaggtttggggtataaactggaggagccaaaaatgaatgaataaagtccgtgtgcgtctgttcgctttactcgttgtatgtatcatattggttttcagtgttctcggcctttttttacagcagcttatttcttcatccgctgaagaaagaacggcggatcagctgaaaaaggaatcggtatacatagcgggccttcttgacaccggccgaatcggcaataaaagcaatgaaacggtaatccgtgacgccggccgcaccctcggtataaacgtctccttgctcaacgagaagggtgacgccgtatatcattccggcagtcgtggtgatgattcagccgtaaaggagttcatttctcacaataaaagcgaggaagccgtacagtcgaaaagcagagtcatccgcggcactgccgtaaaaaatgacgccgggaaaattgcggggtatgtactcgtttcctcggatatcaacggcggttcaagcgttaccggagaaatgtggggcatgctggcagcaagtctttgtaccgcttttatcattatcgttttcttttatacaaacatgacgtcgcgttacaaaaaatcaatcgacgccgcgacaaaggtggcgacggagctgtccaaagggaattacgacgcccgctcctacagcggttacgcaaggcggtcggaccgtctcgggcgtgcgatgaacagcctggcggtcgatttaatggaaatgacaagaacgcaggatatgcagcgcgatcgtctgttaaccgtcattgaaaatatcggatccggtttgattttaatagacgggagaggttttatcaatctcgtgaaccggtcatacacgaagcagtttcatacaaagcctgaacgtctgcttcggcgcctttaccacgatgcgtttgaacatgaggagatcattcggcttgtcgaagacatttttatgacggagacgaaaaaatgccagctgctcagacttcccatcaacattgagcggcgctactttgaagttgacggcgttccgatcatgggccctgatgatgaatggaagggcatcgtcctcgtttttcacgatatgacggaaattaaaaaattggagcagatgagaaaggacttcgtcgccaatgtctcccatgaactgaaaacaccgatcacctcgattaaaggatttacggaaacactgttagacggagcgatgaaagacgaaaaggcgctttcagactttctgtctatcattctgaaagaaagtgagcggctccaatctctcgtgcaggatttattggatttatccaagatggagcagcaaaactttacgatgcgcgtagagtcctttgatgctgcaaaaattctgcatgaaattgaggcgcttttgcagcataaggctgaggaaaaaggcatcagctttcagctcgatctcccggaagagccgatttttgtgacgggtgatgcgcacaggctgaagcaggtatttttgaatctggcgaacaatgccctgacctacacgcctgaaaaagggacggtggggatttcggtacatgtgaaagaaaccgttgtcgatatcaaagtgtccgatacgggaatcggcattcagaaagaagagatcccgcggatatttgagagattctaccgcgtggataaagacagaagccgcaactcgggaggaaccggcctcggcctcgccatcgtgaagcacttaatagaagcccatgaaggtaaaatcgaggtcacaagcgagcctggacagggaactgtgttcactgtgacgctgaagcggccgccggcagcgtgatcagctttacaaaggattaacaatttcttcatgacctgttaaacctatcttgttaggatataacagaaccccttcatccaaggagccaattttgacggcgggaacgcgttttcttgttcccgtccttttttgcgttttcacggggtccgctcattttcctttcaaattgaactttgttaaaataagagaagctgtgagattaaaaaacagaggaatgacgagcttttgctcttaggaggatattgaatgacggaacgaaaaaaattagtgcttgtcgacggaaacagtctggcgtaccgggcgttttttgcattgccgcttttaagcaatgaaaaaggcattcatacaaatgccgtatacgggtttgcgatgattttaatgaaaatgctggaggatgaaaaaccgacccatatgctggtggcttttgatgcggggaaaaccactttccgccacagcacgtttaaagaatataaaggcggaagacaaaaaacgccgccggagctttcagaacagatgccgttcatccgtgagctcctcgatgcctacaacatcagccgctacgagcttcctgaatatgaagcggacgatattatcggcacgcttgccgtatctgctgaaaaagacggcttcgaagtgaaggtcgtttcgggggacaaggacttaacccagcttgcaaccgggaaaacgaccgttgccattacgagaaaaggcattaccgacgtagaagattacacgccggagcacgtgcgggaaaagtacggtctgactcctttgcaaatcattgatatgaagggattaatgggagattcatccgataacataccgggcgtccccggcgtcggagaaaaaaccgcgattaagctcttaaagcagttccattcggttgagaaactgcttgattccattgatgaagtcagcggaaaaaaattaaaagaaaagcttgaagaatataaggaacaagccctgatgagcaaagagctggcgacgattatgacaaatgcgccgattgaagtcaagcccgaagatttagattaccaagggtttgaccgtgaacaagttgttgccatttttaaagacctcggttttaatacgcttcttgagcggctcggtgaagaaagcggggaaacggcggaagaaaattttgaagacatcaatgtcgaaacggcagaagaaatcaccgaagatatgcttgtttcgccgtccgctttggtcgtcgaacaaatcggtgataactatcacgaagaaccgatcctcggcttttccatcgtgaatgaaacaggtctttattatattccgaaagaaatcgccattcagtctgaagcttttaaatcttgggctgaagatgaatcgatgaaaaagtgggtgttcgacagcaaacgttccgtcgtcgctttgcgctggcagggaattgagctgaagggaacggaatttgacgcgcttcttgctgcctacattataaacccgggcaattcgtacgacgatgtcgcgagcgtagcgaaagaatacgggctgaatatcgtttcaaaagatgaagcagtatacggaaaaggcgcaaaacgcgccgttcccgctgaaaaagagcttgccgatcatctcgcgcggaaagcgtctgccgttaacagcctccgtgacaaactgcttgacgctttggaagaaaataatcagcttgagctttatgaagatcttgaactcccgcttgcgctaattctcggagaaatggaatcaatgggcgtcaaagtggatgtggaaagactgaagcgaatgggagaagagctcaaggcaaaactgaaagaatatgaagaaaaaatccatgacatcgccggtgagccgtttaacatcaattcaccaaaacagctcggcgtcattctgtttgaaaaactcggcctgccgccagtaaagaaaacaaaaacaggctattccacttcagctgatgtgcttgagaagctcgcagacaaacatgatatcgtcgcgtacattctgcaatacagacaaatcggcaaactccaatcgacttatattgaagggctgctgaaagtcacgcgcaagggttctcataaggtgcatacacgattcaatcaggcattgactcaaaccggacgcctcagctcaacggatccgaacctgcaaaatattccgatccggctggaggaagggcggaaaatccgtcaggctttcgtaccgtccgaaccggactggcttattttcgccgccgattattcacaaattgaattaagggtgcttgcgcatatttcaaaagatgaaaatctgatcgaagcgtttacgaatgacatggacattcacacaaaaaccgccatggacgtgtttcatgtcagtgaagatgaagtgacacaagcgatgcgccgccaggcaaaggccgtcaatttcggcatcgtttacggcatcagtgattacgggctgtcgcaaaacctcggcatcacccggaaagaagcgggcgcttttattgaccgctatttggagagcttcccgggcgtcaaggcgtatatggaagaatcggtgcaggaagcgaaacaaaaaggatatgtgacgacacttatgcagcgccgccgctatatccctgagctgaccagccgcaacttcaacctgcggagctttgcggaacggacggccatgaatacgccgattcagggaagcgccgccgatattattaaaaaagccatgattgacatggcagctgagctgaaagaaaaaaacctgaaggcgcggctgttgcttcaggtgcacgatgaattgatttttgaagcgcctaaggaagaaattgaaatattagagaagctggttcctgaagtgatggagcatgctttggcattagacgtgccgctgaaggcggattatgcttcagggccgtcttggtacgatgcaaaataaacagaaaaaaaggaagtgatgattgtgccggaattaccagaagttgaaacggtccggcgcactctgaccggtcttgtgaaggggaaaacgattgaatcggcggatatcagatggccgaatattatcaaaaaacccgccgagccggaggaattcgcgcggcagattgcaggagaaacgatccgatccatcggaagaaggggaaagtttttgcttttccatttggatcattatgtcatggtgtcccacctgcggatggaggggaaatacggtcttcatcaggccgatgagcctgacgataaacatgtgcacgtcgtgtttaacatgacggacggaacacagctccgctaccgggatgtccggaaattcggcacgatgcatttgtttgcgccgggagaggaacggaatgcattaccgctttcacagctcgggcccgaacccgatgatgaagcatttaccgccgcttatttaaaagagcggcttgcaaaaacgaaccgcgcggtaaaaaccgccctgctcgaccaaaaagcggtcgtcggcctcggcaatatttatgtcgatgaagctttattccgggcgcgtattcatcctgagacaaaagcgaacagtctgtcggacgggcagataaaaacgcttcatacagaaattaaagacacccttcaggaagcgattgacgcgggcgggagcaccgtccggtcttatatcaattctcaaggggagatcggaatgtttcagctcaaacattacgtatacggcaaaaaggatgaaccgtgcaaaacgtgcggcacgatgatttctaaaatcgtggtcggcggaaggggcactcatttttgcgcccgctgccaaaaaaaatcataaactgaagctgttcaagcaggcggcagcagaatgacttttttctaacacagttgatgacctttctccatatatatattgtgattcacccaataggcatatgtcacaattgccgatcaagagaaagggagaaacggatatggagattgtttctttgctgcttttggcttttgctgtcagcttggacagtttttcagtcgggtttacgtacggtttgagaaaaatgaaaatcccgttcaaagcgattgccgtgatcgcctgctgttcagcctctgtgatgtttatatccatgctgatcgtccattttctgacaaagatttttcccgtatccgtcacggagaaactgggcgggctgatcttaatcggaataggggcatgggtcatctggcaattttttaaaccggctaaagagccggattacttattgcatgaaaaaacgctgcttaatcttgaagtgaaatcgctcggcatcgtcattcatattttgaaaaaaccgaccagcgccgatattgatcaatccggaaccattaacggagtcgaggcgcttctgctcggtatcgccttatccattgacgcgtttggcgccgggctgggagcggccattctcggcttttctccggttatgatgagcgtgactgtcggggtgatgagctcgctgtttgtttcactcggcataaacgcggggcatttgctttcaaggtggaattggatagataaaatgacatttttgccgggagtcctgctgattatcatcgggatttggaaaatgtaagaaggagtgggctttttgagcttggtcatcggtttaacgggaggcatcgcaagcggcaaaagcacggtagcgcgtatgctgatcgacaaaaaaataacagtcattgatgcggatgtcatcgcgaaacaggcggtggaaaaaggaatgccggcttacggacaaattgtggaagcattcggaaaagacatcctgctggaaaatggcgatattgacagaaaaaaactcggttctatcgttttcactgacgaacagaagcgtctgaagctgaatcagatcgttcatccggcagtgcgtgcggaaatgctgaaacagcgggatgaagccattgcgagaaaagagcagttcgtcgttttggatataccgcttttgtatgaaagcgggcttgattatcttgtcggcaaagtgctcgtcgtcaccgtaccggcagacattcagctcaaacggctgatggagcggaattccctgacagaagaagaagcgatgagccggataacgtcgcaaatgcctttagcggacaaaacaaaaaaagctgacgccgtcattgataacagcggcagtcttgaatatacaaagcaccagcttgaggaagtattgagcggctgggcataaacaaacaccgttcggaaagccgaacggtgtttttctggttaaaaatcaaaattgtcagggtccggaccgacacggagattttcgttcagatcatcaatccgcttcatatcttcagctgacagttcgaaatcaaagacatttgcattttcttcaatacggtgttttttagttgatttcggaatggtgatgacaccgttttgcaaatcccagcgcaaaatcacttgagcggctgatttgccgtatttctcagcaatctcctgtaatacggggtgatcaagcagctgcccttgcatcaatggcgaccacgcttcaagctgaatgccttgttcagtgcagaaagcaagcagttctttctgtgtcaggcgcgggtggtactccacctggttgatcatcggcttgatttccgtttctttcatgagatgtttcaggtggtgaatttggaaattgctgaccccgatcgccttaatgcgtccatcccggtagagggtttcgagcgcccgccacgcatcgatgtactttccttcgacaggccaatggatcaaatataaatctaaataatctaaaccgagtttttctaagcttgtgtcaaacgcttttaacgtttcttcatatcctaaatcggcattccatacttttgacgtgacaaaaatgtcttcacgttttaatcccgcttcttgcagcccttggcggatcccttcgccgacaccttcttcatttccgtaaatcgcggcggtatcaacgctgcgatagccgtgcaccaatgccgttttcaccgcgttgacgagttccgcgccttcctctactttgaaaactccgatgccgaaccaaggcatctctactccgttatgcaatgttgcttttgcttgtaaatgtgttgtcatgtatatattcctcctattatttgtctgttgaaaaaaatcaaaatgcgctgaagaaaaactcacctcctttcaagggcagtgcgatcccgcttttccagcttcctgctccatccggttaatacgaccgcgctgagcaccatcagcgccccgatccaagcggtatgaatgattccgattgagtctgtaatgattccgccggcaaacgagccgatcgcgattccggcattaaatgccgcgatatttaaggctgatgctgtatcaacggcgcttggcgcaaaacgttcactcagcatcacaacatatacctgaagccccggcacattcataaacgccaacagccccatgaaaataatggtgatcagcccggctgttttaaacggcgcggtaaaagtcaggacaaacagcacagcagcctggacaatgaacatataaaacaaggctttcagcggattacggtttgataaacggccgccaatcatgtttccgatggcaatcgcaattccgtaaatgagcaggatggccgcgacggtttctttctgaaaaccggttacctcctgaagaagcggagataaatacgtaaacacgacaaacgttccgccgtagcctaacgctgtgataataaataaaagcaataaccggccgtttgtgacgagtttgacctgctcggaaaatgcggttttcgtccctttgcgcaaatgtgacggaacgagaagcgcgtttgtgaggaatgcgatgattcctaccgccacaatcacggcaaatgcgattctccatccgaattgctggccgagataggtgccgaacggaacgccggtcaccgtagccaccgtcagccccgtgaacataatggaaatcgcgcttgctcttttatgctccggcacgatattggcggcgatcgttgccccgattgacatgaaaatgccgtgggaaaaagccgaaatgacccgtgccgccagtaagacgccgattgaggaagcgctcgctgcgagtgtatttccggcgataaaaatcaacatcacccagagcagcagtgttttccgcgacatgccggatgtgagagacgttaaaaccggcgcgccgaatgtcacgcccagagcatacatggaaacggtaagtcccgccgttgtcacaggtatatgcagatcttgagatataagcggcagcagtccgacgctgataaattcggttgtgccgatcgcaaaagcgctgacggctaatgccagcagcgctggtaaatagctttggcgatgtgaagacatctgttttcctccttaaacgataatgtatggttgaaatgatgccgggtaaacgatataagtataagagtacattccttttcagccggcaaatgtcattatgattgatagaagtgtcattgaaaagaacgtacttttaagtgccataggcactttttagttcctatagatgaggaggaattaccgttgctgaagaaaaaatacaatatatccgtagaggcggcgcttgaagtgatcggcggaaaatggaagtgtgtgatcctctgccacctcatgcgcgggaaaaaacggacaagcgaattgaagcggcttatgccggacatcacccagaagatgctgacacagcaattgcgggagctggaagctgacggcgtcatcaaccggatcgtgtacaatcaggtgccgccgaaagtggaatacgagctgagtgaatacgggcacagtctggaaagaattttaaatgcgctgtgtgactggggcgcgatgcatattgctaaacggtacggcgaggtgtcttccgttttagaggacagcattttgaatgacaaatttaaagaaccgggacaaatataagaaaaaagcaggcagcctgagacgctgatcctgctttttttatggaagaaaaatcattttatatgcaaaaaaaccgattgaacaacatattgatcggtataagggtggatttttatcaagttgtactggcggatttcttttaatgtgttatactatatataaataaaggtaaattagagtggcatattaaaaaggggtgacctgagcatgaaggtaaaagtagcaataaacgggtttggaagaatcggaagaatggtgttcagaaaagcaatggaagatgatcaaattcaaataacagccattaatgcaagctatcccccggaaacgcttgctcatttgataaagtatgacacaattcacggcaaataccatcaagaagttgagactgccgacgacagcctgatcgtcaacggaaaacatattatgctgttcaatcgccgggacccgagagagcttccgtggaaagaatgcggaatagacatcgtcgtagaagcaacggggaaatttaattcaaaagaaaaagcgatgagccatattgaagcaggggcgaaaaaagtcattttaacggctccgggcaaaaatgaagacgttaccattgtcatgggagtaaatgaagagcagttcaaccccgatgaacatgtcattatttcaaatgcatcctgcacgacaaactgccttgcgccggtcgtcaaagtgcttgatcaggaattcgggattgaaagcggcctgatgacgactgttcacgcttacacgaatgatcaaaaaaatatcgacaatccgcataaagatctgcggagggctagagcgtgcggagagtccatcattccgacttctacaggcgccgccaaagcgctgtcgctcgtgctgcctcatttgaaaggaaaacttcacggtctcgctttgcgtgttcccgttccgaatgtgtcattagtggaccttgtctgcgatctgaaaacagatgtgtcggccgagcaagtgaacgccgctttccaaagagcctcaaaaacgtcgatgtacggaattcttgattattcggatgagccgctcgtttcttcggattataatacgaattcacactctgcgatcatcgacggactgacaacgatggtgatggaagaccgaaaagtaaaggtgctcgcctggtatgacaatgaatggggatattcctgccgggtcgttgatcttatccgtcacgtcgccgcgcgaatgaaacacccgtcagctgtgtagactaaagatcatggacatttgttagaaaaaaacccttaacggcatattcgcaaaaaacacaccttgcaaaataaacttaaacacagtatactatctttcgtgaacttcttgctcgtgactgcttcggaattacttaaagggttaggacctctccggactaactttcccccgtggtaaatggccgggtcagttctcggaaattcacttttttaattcttgttaaggggggtccatgattatggaaacaatggggcgtcacgtcatctccgagctgtggggatgcgattttgataagctcaatgacatggattttattgaaaaaacgtttgtaaatgctgctttgaaatcaggagctgaagtgcgcgaggtcgcatttcacaaatttgcaccgcaaggcgtaagcggagtcgttattatctctgagtcacatttaacgattcacagttttcctgaacacggatatgcaagcattgatgtttatacttgtggagacctggatcctaatgtggctgcggattacattgcggacgcattacatgcagatacaagagaaaacattgaaataccgagaggaatggggcctgtacagattaaacaggcacaagcgaaagtactgtaattttcaaaacgcaaacacaagggagctaagctgaaaaagccattacgcgctttgaagctgatgctccttttctaatgtaaaaaaacagcattgctttttctttaagcattttttttgtaaaatagaaaagataaggccggtctatcggctctcccaacaaataggctcatcctagaaacgttggcgggcatttaccggaagcttgcgaaccgcattacagcaacgaaacagatgggagctgatccaatttgaaatgtccttcatgccagcataacggttcccgcgtacttgattcacggcctgcggacgaagggaaatcaatccgcagaaggcgggaatgcgaagcctgccattaccgcttcactacatttgagaagtttgaagagatgcctctgatcgtcgtgaaaaaagaaggcgtccgggaagaattcagccgtgaaaaaatgctgcgcgggttaattaaagcttgtgaaaaaaggcccgttcctttgaaaacattggaagacatgtgctttgacattgaaaaagagctgagaaaccaaggcgtatctgaagtcaaaagcgaacttgtcggtgaaatggtaatggaccgcctggcgaaaatcgatgaggtgtcttatgtccgctttgcctccgtctaccggcagtttaaggatataaacgtgtttatcgatgaattgaaagatttaataaagaaagaacgctgagagagctaagagattgtgtctggctcttttctcatgagcaaaattggcatttgatagatcgcagaaacggtgtaaaatgagagtagaaacatatcggaaggtttgagaatcatggctgactattggaatgacgtattgcctgtagatccttatacggtcaaaagccgttcgcttcttcaggatgtcgacagacaggttttgacacatctgtaccagccgctgatcggttcttttgcattctccctttatatgaccttgtggggggagcttgagcagaaccgcttgtggggagcggaatccacgcacaggcagctgatgggcatgatgcagtcaaatttaaaaaagattcatcatgaacagggaaagcttgaaggaatcggactgctgaaagtgtatatccgggagtccgagcaaaaagagcggatgtttatttatgagctgctgcccccgctcaggccgaatgatttttttgaagacggcatgctgaatgtctttctttataacagagtcggtaaaacgaaataccagcagctgagacaattttacacgcacccttccgtcggcgcgggcgcaagggaaattacccgtccgtttaatcacgcttttgcctcttttcagccgagtgaatggaaaatgacgcctgatatggaagaggcgatgaagctccccgaggactatgagacggcgtctgtcggacaagcgccatcctatacggtgacggaggaagtgtttgattttgagctgtttttggcggggttatcagaaacgatgataccgcgcaaatcaatcacacaggatgtgcgggagagcattaaaaagctttcatatttatacggaatagatcctatttccatgcagcacgtcgtcatgaccgcaattaatgaacaggatacgataacggccgaagcgctgaggaaagcggccagcgactggtaccaaattgaaagaagcggcaagcttcccgaactgattgataaaacacagcctgtcaccttgagagaaaatcggacggaaaaggacgattcattgaacggcgaactcatcgcacagcttgagaccatatcaccgagaaagcttctccaggacattgcggacgggaccgagccgtcaaaagccgacctgcagattatcgccgatattatgttcgaacaaaagcttgagcccggcgtcaccaatgtgctgatttattatgtcatgctgaaaacggatatgaagctgtccaaaaactatatccaaaaaatcgccgcccactgggccagaaagaaagtcaaaacggtacgggaagcaatgaagctcgcaatcgaagagcacaggcaatatcttgattgggcggacggcaaaacaaacggcgcggcgcgcggcaaaaaaaccgtccgggaagaaaagcgccctgattggatgaaagaagaagaaaccgggaagaaacaagaacagacggctctttccgcacaggatcttgaagaacagaagaaaaaaatgatggaagaaatgaaaaaactgaaaaaatactctgcctattgagacagagaagcggggtgatatttaatggaaccgatcagccgatccttagaaggcgtgacgaaaagacctgactttcaaaaacgcctggaacgaatgcagcagcaagttatggccgacgaagacgtccaggcttttttgaaggaacagaaagatgttatcaatcaaagcatgattgacagagggttaaataaactgtacgaattcgttcagcaaagcaaacagtgcgccttctgttcgaaagacagccggacgaacagcctgcttgaaggctaccatccgaagcttgtgatcaacgggcgttccattgatattgaatattacgaatgtccggaaaagagaaagctcgaccgccagaaaaggcaaaagtccctgatgaagagcatgtatatccagcaggatcttctcggcgcgacgtttcagcagatcgacattaccgatccgagcagactcggcattttccagcatgtgacggattttctgaagagctataatgaaacgggaaaaggcaaagggctgtatctgtacggaaaattcggaatcggaaagacatttattttagccgccattgccaacgaactggcggaaaaagagtattcatcaatgatcgtatatgttcccgaatttgtcagagagctgaaaaactcgcttcaggatcagtcgctggaggcgaaactgaatatggtgaaaacgacgcccgtactgatgcttgatgacatcggagcggagtcaatgacaagctgggtcagggatgaagtcatcggcaccgtgcttcagcacagaatgagccagcagcttcccactttcttctcgtctaatttttcaccagacgagctgaagcatcattttacgtattcacagcggggagaaaaggaagaagtaaaagcggcaagactgatggagcggattttatatttggcttcgcccatccgtcttgacggggaaaaccgccgccgttcatgatgccggcgtccaatgggaaggatttgagggaatgaggaataagaaggctgtcacttgggctgcggctgcggcgggagcgggtcttttgctgtgggcaaaccgcaaatatctgaatctgtcgcctaaggagatccggctgtgggtgttatcgttcggtgtttttgcgccgcttgtgtttatcggaatttccatcgtcaggccttttgtgctgtttcccgtatcaatcgtttccgtcgccggaggattggcgttcggcccgtttttcggcaccatgtatacgctggcgggctcaatgggcgctgccgccgcgtctttttttgcggcggggctgtttgcctttaatgagaaaagccgtcatggaaaaatggaagccattcaaaagcagatgaaaaccaatggcttcttttatatttttatcctgcgcattctgcctgttaactttgatgtgatcagctatgccgcgggcctatcgaaagtcaggccggtaacgtattttttggcgaccgcagcgggcatcattccggggacgatcgtcctgaatgtgctcggcgcgagctttatgtccggcaatgtgctgaccgtactctgtgtgatctgtctttacatcgtatttttatcgcttcccgttatatttaaaaagaaggtgcgtcatttgttcggcggtgaaagctaacctttacgtctattttaaaaacatcccccatatacttgtaacagatgccgtaaggggggacaaatatgcttgaagtgatctttgaagatgaccacgataccgccgcttttttacatctcattcagcaatcggacgaccggagacattttattgtccgtgaaggcataaaaaaagtcggaatcgcaaggtctgaaacggctttttgcgttcagcgctttattgagccgatacttgtcaggttttttttggaatgcaaagaagacgagcatatgctttcgcttattgaggacgcatactgcttcaccgatcaggatgaacagcagcaaatccttcagcttgcacacagcattatggaaggagagcttgaggatcatccgtttgagccgaagaaagagccgcgcacacagtttatttcagatgcgctccggacgatttcacttgatgcgggtgttttttccgtgcgttcgtttcagacgttccggctcggcaggtattatgagaggctcagagaatatgcggaggccgcgatagatgaataccggatggaacaggaatatcaaaactttatccagtctctgagagattatgtgacatccaatccgccgcggatgaagaaagtccgcatcgtacatgaccgggcttttacgctgtgggagctgcgctatgtgtcagaacgggaacagaaaaaatacatagacagacggtttgtgcgggagcacccgatgtatatagattcccatctccttgcgccgctgatctccattgcgcctgagacggtcgaactgtatacggacaaaccggaacatatgatgtcaagaaccattcaaaacgtgtttcaggagagggtgcgcctttttccgctgggcgcgtttgcagccgagaagacggaaggatagccgcacggacggccttgtgtaagcggcagggctgtctgtgcgaaatcagacggaaaaccgagttgcatttttctcacagacattttataatacataaaagattaatgattgctacacgtattgataaggacatgaagcattgataccggctttataagagaggagagcccaggctgaaagctttccagctatggatcattgtctttaccgcctttgaacttcagctgtgaacgccggaataagcgccagtaatagctgacgggaactcccgttacagagcttagagccgcagtgccgaagcaatcggccgcgcggaaaaaagggtggaaccacgattccgtttatttaacctcgtccctttcatagggggcggggtttttgatttgcataaaaaaaggagtgacgaagatgtcagatatgatcaacatcacatttccggacggagcggtaaaggaatttccgaaaggaacaacaacagaagatatcgcggcatccatcagtccgggattaaagaaaaagtctttagccggaaaactgaacggacaggaaattgatttaagaacgccgattcaagaggacggtgccgtagaaatcattacagaaggcacagaagaaggtttgaacatcatgcggcacagcacggcgcatttattggcccaggcgattaaacgcatttataaagatgtgaaattcggagtcggccccgtcattgaaaacgggttctattatgacgttgaaatggagcaggcgctgacgccggatgaccttccgaagattgaaaaagaaatgaaacgcatcatcggtgaaaatctgccgatcatccgaaaagaagtgagccgtgatgaagcaaaagccatgtttgcggaaatcggcgataatctgaagcttgaactgctggatgcgattccagaagacgaaacggtctctatttatgagcagggcgaattttttgacctgtgccgcggcgtgcacgtgccgtctacaggcaaaattaaagaatttaagctgctgagccttgcgggcgcatactggcgcggcgacagcaaaaaccaaatgcttcagcggatttacggcacggctttctttaaaaaggatgacttgaaagagcatttgcgcatgcttgaagaagcgaaagagcgtgaccaccgaaaactgggcaaagaattaaaattgtttgccaactctcaaaaagtcggacaaggtctgccgctctggctgccgaaaggcgcgaccatccgccgcgtgatcgagcgctacattgtggataaagagctgagcctcggttatgagcacgtgtatacgcctgtcctcggaagcaaagacctgtacgaaacatcagggcactgggatcattatcaggatacaatgttccctccgatggaaatggacaatgaaacactcgtgctccgtccgatgaactgtcctcaccatatgatgatttacaaacaggacattcacagctaccgcgagcttccgatccgcatcgccgagctcggaacgatgcatcgttatgaaatgtccggggcgctttcaggtcttcagcgcgtacgcggcatgacgttaaatgacgcgcacattttcgtccgccctgatcagattaaagaagaattcatccgcaccgtccgtttgattcaagacgtatacgaagacttcggactgagtgattacacattccgcctgtcttaccgcgatcctgaagatacggaaaaatattttgatgatgatgagatgtggaacaaagcgcaatccatgctgaaggcggcaatggatgagatggggcacgactattatgaagcggaaggcgaagcggcgttttacggccctaaacttgacgtgcaggtgaaaacggcgatcggcaaagaagagacattgtcaactgtacagcttgacttccttcttccggaacgctttgatctcacttacgtcggagaagacggcaaacagcaccgccctgtcgttattcaccgcggcgtcgtgtcaacgatggagcgtttcgttgctttcttaatcgaagagcacaaaggcgcccttccgacatggcttgcgccggtgcaattccaagtcattcctgtatcaccgtccgtgcatcttgactacgcgaaaaaagtccaggagcgcctgcagcgcgaaggcctgcgtgtcgagcttgacagccgggacgaaaaaatcggctataaaatccgtgaagcgcaaatgcaaaaaatcccgtacatgcttgtggtcggtgaccaagaagcggaaaacggcgcggtaaacgtccggaaatacggcgagcagaaatcagaaaccgtctcattggacgattttgtgaaaaaggctgtagcagaagcgaaaaaataaccggaaatacaaaaaaccccgttcattcagaatggggttttttagcgtataaaactatctttctttttgtttctctataatcgcaaacagctcgtgaagatcgctgatcatgtaatcaggcgcaatgtccgtatcatttttcttttgtgtccggtttacccagactgtcgtaatgcctgcccgtttcgctcccaatatatcagtattgaggttatctccgaccataatggcgtcttcttttttcaggttcaggaggccgaggcaatgttcgaatatggaggcatcgggtttcccttttccgaaagcgcctgagatgacgatttcattaaaataaggcgcgagctcaggaacgccggctagtttttctttctgcaggctgggatcgccgtttgtcagcagaagcaattcataaacacctttcagcttatcaagcaccgcaaacgtttcatcatacacatacgggcgctgtctgcgttccgccgcgaaaaactccgccaaatattcgccgtaagccgcatcgtctataccgacgctttttaagccgttcgtccaggcgtttcgtctgtattccggcgcaatccgattcagctgtttaaatccttcgctgaccggctcggaaaaattcgcccataatccttcaaacggattaatgccgatcatgaccgtataaggataggtttcgtatgacatatacaattcccgtgccgctttccgtaccgcctcttcaaatgtttgcgggtcaaggccatattttttttccgcttgtaaacatgtttccctgaatgttgttctgacgcttttttcatcccataacagtgtatcgtccaaatcaaaaaatacggctttcatgatcttctcctcttttttatattctgaaactctctgccgcaaggctcccgtttattctacaatagatacatagactgtgaaagatttgttttcagatgatttgaaaaaaacaggcaggtttgtgtcagattctgtctcaggctctaaaacgtgataaaataaaatttgaaagaacaggtgaaaagtatgctgcatttgatcatcatgatgctggaaagagtcggaattatcgtcatattgggatttgttctggctcataccagattgttcagacaggcgctccagcagcctgagagctataaaggcaaagcggtgctgatttcaattttctcgctgttcagtatcatcagcaactatacgggaatagaaattcagcggaatacaatcatgaataatgactgggtgtttcaaattaatccgtccggttcaattgccaatacaagaattatgggcgttgaaatcggcggactcttaggcggtccgtatgtggggatcggcgtcggcatactggccggcctgcatcgtttatcactcggcggcgcgaccgcagtcagctgtgccgtctcatccgttttagcgggcattttgtccggctggatcggacggtatttcagaaaacgctatgcgatgccgacaccgcgtgtggccgcgcttgtcggactcggaatggaatcgctgcaaatgctgctcatcctcttgatggccaagccgttttctgatgcttggacgcttgtgagcatcatcggcatcccgatgatattggtaaacgggtcagggacttttatttttctttcgatcattcagtcgattatccgaaaggaagaacgggcgagagcccttgaaacccacagggtgctgatgattgccgatcagacgcttccgtttttccgccaagggctgaatgaaagctcatgcaaaagcgtcgccgccatcatccacaggcaaacaggaacggacgcggtatcgcttacggataacgaaaagattttggcgcacgtcggcgcgggtgccgaccatcatattccgtctgaaagcctgatcaccggattgtcaaaacgcgtcattaaaacgggtcatattatgaaagcgacatcaaaggaagaaattgaatgcacgcacgatccctgtccgctgcatgcggcgattgtattgccgctgacgtcaaacggcaaaacgatcgggacgctgaaaatgtactttaaaagcccgtcaggtttaagccgggttgaagaagagcttgcagaaggactcgccatgctgttttccacccagcttgaactcggcgaggcggaactgcagagcaaattgctgaaagacgcagaaataaaggcgcttcaggcacaggtcaatccgcattttctgtttaatgcgatcaatacgatttctgcactttgccgtacggatgtggaaaaaacccgaaagcttctgctgcagctcagcgtctatttccgttccaatctgcagggagcaaggcagctgctcatcccgctttctaaagaactgaaccatctgcaggcgtatttatcattggagcaggcccgttttcccgggaaatataaaatcagtcttgaaatcgaacgcggtttggaggacatcgaaattcctccttttgtgctgcagattctcgtcgaaaatgcgcttcgccatgcattttcaagaaagcaggacagctgtgccgtcaatgtcagcgtggtatccgccggtcagtcggttttaatgcgggttggagataacggtaggggaattgatccggaattgctgtccgtgctcggaaaccgtccgctcccttctaaagaagggactggaaccgcgctttacaatttaaatcagcggctgatcgggctgttcggcccacaagcagccctgcgattggaaagtgaggccggcaaaggtacggacgtatcatttgagctgcctttgaaactgatgactaaaggagaagaacatgctgaaggtgttaatcgttgatgatgaaatgctggcaagagatgaattagcttatttgctgaaacggacgaatgaagtaagtgacataaacgaagctgaaaatattgaatccgcttttgacagtatgatggatcaaaaaccggatctgctgtttttggacgttgatttgtcaggagaaaacggatttgacattgccaaacggctgaaaaacatgaaaaatccgccggccgtcgtttttgcgacagcgtatgaccaatttgctttaaaagcttttgaagtcgacgcgctcgattatttaacgaagccttttgatgaagaaagagtgcgccagacgatcagaaagtttaaaagagtgaagctggacagggcaggagccgtctcggagcagccgtccgcagccggagcgcataaactggctgtatcagccggtgaatctattgtcattttagatacgaaggacattatttacgccggcatggaggacggacacgtttccgtcaaaacgtttgccgcgtcttattccgttcatgaaactttggcggtcattgagaaaaaactgcctgatacgggtttcttgagagtgcaccgcgcgttcatcgtgaatacggagcatattacggaaattcatccgtggtttaattcgacttacaatctgatcttaaaagacggctctaaaattcccgtcagccgtacatacgccaaggacttaaaaaagctgcttcatattatatgaggcggcttttgcatttcagcagccgttttttgcatttcagaatgaatattcagccgtttgttatgaaagcgctttaaaaatcaatttctcttttataatggacctaacaaagagaaagaggtgaagaaaatgagtgcgaaaaaagtgtacggatttctgacacaagcatttatttttgccgtaattatgctcatatctaatgggattgcagcgattgtccccattcctatacccgcttccgtagtaggtttggtgttattatttgtcctcttatgcctgaaagtgattaagcttgaacaagtagaaacgctgggaacatcattaacgtcactgatcggatttttatttgtcccgtcgggcatctccgtgatgaattcacttggcgtcatgcagcagtacggcgtgcagatcgcactcgtcatcttactcgccaccatcattctgttaggggcgacgggccttttttctcagctgatcttgtctgtcagccaaaaacgtcagaaggctgctccggctgataaacaaacggtgcgccgttccaatcaggaaaacgaacttgtgcagcattaggagggaaaacggatgagtccatatttcggtattgtcgtttcacttgcggcctttggcatcggcacgtttttatttaaaaaaacgagaggctttttcctcttcaccccgctgtttgtcgcgatggtgcttggaattctttttctgaagctcggcggtttttcatatgaagattataaaagcggaggagacattattaaattcttcctggagcccgcgacgatcgcttttgccatccctttatacaaacagcgtgacaagctgagaaaatactggtggcagatcatgtcttccatcattgtcggctctatctgctcagtcacgattgtctatttgatcgcaaaaggcattcatcttgacgcggccgttatgaaaagcatgcttccgcaggcggcgacaacggcaattgcccttccgctgtcaaaagggatcggcggcatcaccgacatcaccgctttcgccgttattttcaacgccgttatcgtctatgctcttggcgctttattcttaaaactgtttaaagtaaagcacccaatctctaagggactggctctcggcacatcaggacacgcactcggtgttgcggtcggaattgagatgggggaagtagaagcggcaatggcaagtatcgcggttgtcgtcgtgggagtggtgacggtgctggtcattccggtattcgttcagctcatcggaggataaacccgggtcatagacccgggttttttattgtgttggcacgtccgcaggcggcaaagaacgaaatttcacatttttccttgcgctcaccccggcatcgtgttaaaatgaaaaagttgatccggagaagtcattcttgactaatgatccggtattgtgtagaatagttattgaattgaatataaatcacaagcagaggcacccgcttctcacctgattgacacattcatgtagttggcaggttgaccgtacatttttatttatgcagatgttcgtagtgtgggtgtgttgtcatgcccgcactttttgtttgcctgcagaatgcagtcaaaaagcgttgtgaatcaattcgaagaaactatggaggtggctcattattagcaaagatcaattggttaatgagggtatccgtgcacgtgaagttcgtctgatcggacaaaatggcgatcagctcggcatcaagtcccgtcaggaagcacttgaaatcgccggccgcgcaaatcttgaccttgtgttagttgcagcaaatgcaaaaccgcctgtctgccgcatcatggactacggtaagttccgattcgagcagcagaaaaaggacaaagaagcacgcaaaaatcaaaaaatcattaacttaaaagaagttagattaagtccgacgatcgatgagcatgactttaacacgaaattgcgcaatgcgattaaattccttgaaaaaggcgataaagtgaaagcttctatccgctttaaagggcgcgcaatcactcataaagaaatcggccagcgcgtattggaccgtttctctgaagcatgtgcggaagttgcgacagtcgaaacaaaaccaaaaatggacggccgcagcatgttcttaatgctcgcgccgaaaaacgaaaagcaataaggaggaaatcccatgccaaaaatgaaaactcaccgcggatctgctaaacgttttaaaaagacaggttctgggaagttaaaacgttctcatgcatacacaagtcacttattcgccaacaaatcccaaaagcaaaagcgtaagcttcgcaagggtgctattgtgagcgcaggagacttcaaacgcatcaaacaacagcttgccaacatcaagtaatcggacaaggaacaattaggagggaaatctaatgccaagagtaaaaggcggaactgttacacgtaagcgtcgtaaaaaggttcttaaattagcaaaaggttatttcggttcaaaacatacattatacaaagtagcaaaccagcaggtcatgaaatcaggaaactatgcattccgtgaccgccgtcagaaaaaacgtgatttccgtaagctttggatcactcgtatcaacgctgctgcacgtatgaacggtctttcttacagccgtttaatgcacggtcttaagctttcaggcatcgaagtaaaccgcaaaatgcttgctgatcttgctgtaaacgatcttactgctttcaatcagcttgctgatgctgctaaagctcagttagacaagtaagttgaaaaagccgctctctttccgggagcggtttttttacgtaaagggtgacaatcaatggctctcttcatttacgccgtattgataaacggatacggcttttggatcatgggcgctgataaaagaagagcaaaggcgcacaggtggagaatatcagagaaacgaatatggctcacagccgccatgttcggctcactcggcgtatggatcggcatgcgcaccttcaggcataagacgaagcacaaatcctttttatacggggtgccgctgctttttctcactgaagccgcccttgtgctcatgtatttgatgtataaaaaataaaaagcaggagagcttatcgctcgcctgcttttttcgcttttttgatgggctggtcccaatcaatcttgcaattcgggtaccgctccaatacctttttttcgacttcttcaaaatcatctgcagaaaagcggttcagcttttccggattttcggtccatacaaatatcgtatgaataaacagcggatgatctttggaagggatatgcttttctccttcaaagagcactcctttataagtaagctggagattttttcgcgtgtttttctgttcgtcaataaaataaaaattctcttttgattgcgccagtctgagccttcttttcgggtttgcgtaaaatttgacgcacatgtaaataaaataaataagaagtgcaagcaagacaatcctcaatactgtaatggccatatgtgtgaaggcacctcctcacctttgtcatgatctgatgtaatacgaaaaacaaaacaaaaagtttcatttttttaaaagaaatagataaaaacatttacccgtttttcaggcgaattaatcgtatgcttcagcattggttttgtataataagaagggtagtgaaaaaaaggaggtttattgatgacaaaattagatgaaacgctcaccatgctgaaagcgttaacggatgcaaaagggataccgggaaatgagagagaagtaagacaagtgatgaaatcatacatagaaccatttgccgatgttgttacaacagaccggctgggaagtttaatcgccaaaaaaaccggcaaagaaaacggtccgaaaatcatgatctcagggcatttagacgaagtcggttttatggtgacgcaaatcactgataaaggctttctccgctttcaaaccgtcggcggctggtggtctcaggtcatgctggcccagcgcgtcaccgtcgtgacaaaaaaaggggacatcacggggatcatcggttcgaaaccgcctcacattctgcctcctgacgccagaaaaaaagccgctgatattaaagagatgttcatcgatatcggggcgtccagccgtgaagaagcaatggaatggggcgttcttccgggtgaccagattgtgccgtattttgaatttacagtgatgaacaatgaaaagcatttattggcgaaagcatgggacaaccgtatcggctgtgcgattgccatcgatgtattaaaaaatctgaaaaacagtgatcacccgaatgaagtatatggggtcggaacggttcaagaagaagtcgggctgcgcggggcgaaaacagcggcacatacgatccagcctgatatcgcgttcggcgtggatgtcggaattgccggagatacaccgggaatttctgaaaaagaggcgcaaagcaaaatcggcgaagggccgcaaattattctgtatgacgcgtcaatggtatctcacaaagggctgcgcgaccttgttgtgaacacggcggaagaagcgggaattccgtatcaattcgattccattgccggagggggcacggattcaggttccattcatttaaccgcaaacggagtgccggcgctgtccattacgatcgcgacgcgctacattcacactcatgccgctattttgcatcgggatgattatgagaatacggtaaaattgatcacagaagtgattaaaaaattagaccgggaaacggttgaccgtattacttatcaataaagatacggaagaatctgcttttttaagcagattcttttttttttgtctgtacaaatatgagccttgcgtctacaataagaaaagacatagaaaaatctgacaacatgtttttgaaagcgctttaaaaaaggggaggatttacaaatgaaaaacagattcagacgcatgatccgcttttcgtgcgcagccgttacagccgggctgctgatgatgtcttcatctccggcatctgccgcgttttggggggcatcaaatgaattgcttcacgatccgacaatggcgaaggaaggaaacacgtggtacgctttcggaaccggtttggaaggggagagggggcttcgcgtcttaaaggcgggcagcggcggcgtatggaccgttcagaaatcaatctttacttccccgctgtcatggtggggcaattatgtgccgaattacgggctgaatcaatgggcccccgatgttcaatattttaacggaaagtattggctgtattatgccgtttcttcattcggcaaaaatacctccgcgatcggtcttgcatcatctacaagcctcagttcgggaaactggaaggacgaagggcttgtcatccgttcgacaagcgccaataactacaatgcaattgatccggagctgacaattgataaagacggaaacccttggcttgccttcggttctttttggagcggcattaagctgacaaagcttgataaaaatacaatgaaaccgacggggtcactttattccatcgctgccagaccgaataacggcggagctttggaagcgccggccatcacctaccagaacggctactattacttaatggtgtcgtttgataaatgctgttcaggcgtgaatagtacgtacaaaatcgcttatggaagatccaaaagcatcaccggcccatatctcgataaaagcgggaaaagcatgtctgaaggcggagggacgattcttgattccggcaatgaccgctggaaaggcccgggcggtcaagacattgtgaacgggaatattttagtgcgtcatgcgtatgatgccgaaaacagcggaattccgaagatgctcatcaatgatatcgattggagttcaggctggccttcctattaattgatcagccgggcatgtgtgtccggcttttttacttgcaataaaagattgacagtttgattcctccttaactataataaagttgttcgtacaaataaaagaataaaagttttattatttatattcgtacgtatatttatttaaaaatgcaagcgctttattttgatgggaaggggaaatgaatgtgcttcagaacaaagaatatgaattttggtttgtaacgggaagccagcacttatacggagaggaaacgctgcagcttgtcgataaacacgcaaagggaatatgtgacggtctcagcggggtgtcatcaagatacaagatcaggcataaaccggttgtcacgtcatctgaaacgatcagagaggttttgcgggaagcgcagtatcaagaaaactgtgccggggtcgtgacatggatgcatacattttcccctgcgaaaatgtggattgaaggtctttccgcttttcaaaagccgatgcttcatctgcatacccagtatcatcgcgacatcccgtgggaaacgattgatatggactttatgaacagcaaccaatccgctcacggagaccgggagtacggatatatccagtcaagaatggggcagacgagaaaagtcatcgcaggctattgggatgatgaggaagtcaaacatgacatttcgcaatggatgaacacggctgccgcttggaatgaaagcaggaatattaaagtagcccggttcggcgacaatatgcggaatgtggcggttactgacggagacaaagtcggcgcccacattcaattcggctggcaggttgacgggtacggaatcggcgatcttaccgaggtgatgaacaatgtcaccgacgcagaaattgaggcgctttatgaggaatacgacaaattgtatgtcatcagcgacgaaacgaagcgggatgaagcaaaagttgcttccattaaagaacaggcgaaaattgaactcggattaacggcctttctcgaacggggcggatatacagcgttttcgacctcctttgaagttttgcacggaatgaagcagcttccgggtcttgccgttcagcgtctcatggaaaaagggtacggatttgccggcgaaggcgattggaaaacggctgcccttgtgcgaatgatgaaaataatggcggacggagaacaaacctccttcatggaagattatacgtaccattttgaaccgggtcgtgcgatgattctcggatcacatatgcttgaagtatgtccgacgatcgcccttgatcagccgaaaatcgaagtccaccctctctcaatcggagggaaggaagatccggcccggctggtttttaacggaatcggcggttcagccatcatcgccagcatcattgatatcggcgggcggttccgtctcattctgaatgaagcggaaggcagggaaattgatcatgatatgccgaatctccctgtggcgcgggtgctgtggaagccggagccatcgctgaaaacagctgcggaagcatggattttggcgggaggcgcccaccatacctgtatgtccttccggcttacggctgaacagatgcttgactgggctgagatggcaggcattgaaagcatctttatttcccgcaatactgaaatacatgagctgaaaaaagagctgaaatggaatgacgtattataccggctgggagggaattgatatggtgtatacgattggtgttgatttcggcacattgtccggccgggcggtgcttgtcaatgtccgcacgggcgaagaaatcgcgtctgcggtaaaagaatacactcatgccgtcatcgaccgcacgctgccgaagacgggtgaaaaactccctcgggactgggcgcttcagcatcctgccgattatatcgaagttctggaaacggcgattccgaacctgcttgagcaggcgggcgctgatccaaaagacgtgatcggcataggaattgattttaccgcctgcacgattttaccgatagacggcgcggggcagccgctttgtatgctgccggaatttgaacgggagccccacagttatgtgaagctgtggaagcatcatgcggctcaaaaacatgcagaccgtttgaacacgattgctgaagacacaaaagaaacattccttaaaagatacggcggtaaaatttcttctgaatggatgatcccgaaaatcatgcaaatcgcggaagaagcgccgcatatatacaaggcggcagatcggattgtggaagcggcagactggatcgtctatcaattgtgcggttcattgaagcgaagcaactgcacggccggctacaaagcgatctggaatgaggagacggggtatccgccggatcattttttcgaaaagctcaacccgttaatgaaaacgattacacaggataaattaagcggcgcgatttattcagtcggggaaaaagcaggaggtttgaccgaaaaaatggcggagctgaccgggcttctgccggggacggccgttgccgtcgccaatgtcgacgctcatgtgtcagtgcccgcggtcggtattacagagccggggaaaatgctgatgatcatgggaacgtctacctgccatgtgctgctcggcgaggaagaacatatcgtccccggtatgtgcggggtcgtcaataacggcattttgcccggatatgcgggatatgaagcggggcagtcctgtgtcggcgaccactttgaatggttcgtcaaaacgtgcgttccgagagactatgagaaggaagctgaggataaacacatagacattcacgagctgctcagcaaaaaagcagcagaacttgttcccggggaaagcggccttctcgcgcttgactggtggaacggaaaccggtcaaccttggtggacgccgatttgacgggcatgatgctcggcatgacgctgcacacgaagcccgaagaaatctacagggcattgattgaagcgacggcgttcggaacaaggatgattatcgaaacgttccgggaaaacggcgttccggtcgaagagctttacgcagccggaggaatcgccgaaaaaaatccgtttgtcatgcagatttacgcagacgtcacaaatatggacattcaattatccggatctccgcaggcacctgcactgggctccgcgattttcggagcgctcgccgcgggacgggaaaacggaggattctccaatattgctgaagtatgcgcgcatatggggaaattaaaagacggcttttatgccccgaaccgggaaagagctgagatttatgacagcttatatgcggaatataaagagctcgtacactacttcggtaaagaaaacaatgtcatgaaacgcctgaaagccattaaaaaccgtgattttgcgaaaggggggagccgccatgcttgaagcgttaaaagaagaagtgctcgccgccaatctgaagcttgaggaacataaccttgtcacgtttacatgggggaatgtcagcggcattgacagagagagcgggagaatcgtcattaaaccgagcggtgtcgattacagtgagctgactgctgacaaactggtcgtcctgaatgaggacggagacattttggaaggctcgctgaaaccgtcttctgacacgccgacccatctttatctgtataaagcgtttccggctatcggcggaatcgttcatactcactcccgctgggcgacgagctgggcgcagtccggaagagacatacccgctctcggaacgactcacgcggattactttgaaagcgctataccctgcacgagggaaatgtatgaagaagaaattgtgaaagattacgagtatcatacaggcaaagttatagccgaaacctttcaaaacgaaccgtatgaacaaaatccgggtgtcctcgtccacagccacggcccgttctgctggggaacggacgcgctgaatgccctgcataacgccgttgtgctcgaaacggtagcggaaatggcctaccattcgcttatgctgaacaaacagcttagtccgatcgacagagtgctgcatgataagcatttttacagaaaacacggggcgaatgcttattatggccaaacttgacgcagccgggtttctgattgatttagacggaaccgtattcagggggcgggagctgattgacggcgcaaaagaagccgttcatacccttcagtcactgggcaaagccgttgtctttttaagcaaccgcggcaatctatcaagagcaatgtgccgaaagaaactgctgggtgccggtatccgcacggatgaacggagcatcgtgctgtcctccagtgtgacggcatcatttttaaagaagcattatcctttgtcaaaggtctgggtgttaggagagaaagggctgactgatgaactcgctttagcgggtgtcgtcctggcgcaaaacccgcaggcggcagactggcttgtcatctccctgcatgaaaccgtcacctataaggatctgaatctcgcttttaaggcggcttcctccggcgcgcgcatcatcgccacgaacaaagaccgctcctttccgaatgaaggcggtcatgccatggatgtcgcgggaatgatcggggccattgaagcatccgccggagcaaaaacggagcttgtcatcggcaaaccgtcttggctgatggctgaggcggcatgtgaagcgctcggacttccccctgaggaatgcgccataatcggagacagcctcgaatctgatatcgcaatgggcaggctgtacggaatgaaaagcatattggttctgacggggtcggccaaacttggggagccccgtctatatgaacctgacatcgtccttgattctattaaagacctgacagaattagcgaaggagggaatccttttatgaaacgttctcctgaggacattcaatccgagtttgacaaggaaggggccagccgctcaccgattcaaatagaagatatcgtgatcggggcgaatgcaaaagaagagcttctcagatttctgcaaaaaaaatgctggaatcatccggtcatcgtctgtgaccggaacacgtacgaggcggcgggacgtctgcttgcggacgaattaagggcaggcggaatcaaagcgtcaaaagtcatcattccggagcatgaagccggggccgccgcggctgatgagaggacattggtctatacgctgatcaatctcgcggaagagacggatgttatcattgcggccggttcaggaacgattcacgacattacgcggtttgccgcttatcagcgcagattgccgtttatctcattccccaccgctccgtcagtcgacggttttacatcggcgggagcgccgctcatattaaacggaatcaaaacgacgattcaaacgaaagcgcccatcgccttatttgccgatacgaatgtattaaaagaagcgccccgttcaatgacagccgcgggcttcggtgacatgctcgggaaaataacatcgctggctgattgggagatttcccgcagccttgcgggtgagccgtactcagaagccggggcgaagcttgtgaaagacgcgctttggcagtgcattgatcaccgcgctgacattgccatgggaacggaggccggcattcagatactgatggaagcgctgatcgtttcgggtcttgtcatgcttgctcttgaccactcccgccccgcctcaggaggagagcatcacatctcgcattggattgagatggaaatgctgaaggcaaaacagcctccgattctccacggtgcgaaggtcggctgtgcgtgcgcggtgctgagtgatatttacaaagaactggcttgtcacgaaaagcttgctgaactgccgccgcactttcgcgaggcgattcagtccgcatatgaagggcttcccgacggcaaaacaattgccgggtggctctcctctgcgggaggtcccgcctgtttcgatgagatcggtgtaaaaaaggaccttgtcagcgatgcacttaagcatgcgcacacactgcgagaccgttataccggtttaaccatcataaatgaaaatgcagcgctctttgcacatcatttgcatcaatagccgcacggcctaaagtggaaggggtaatgacatgaaaaaaacgaccgctgtatgtttggtgctgatgatgctcttcttgtttaccgccggctgttcacaagaacggactgccggccggccgggagaaacggagctgacgttttggacgtttaacggtctgcacgaacagttttatcaggaaatggtcaaagaatggaatcagaagtatccggatcgcaaaatcaagctgaataccgttgtttatccttatggacaaatgcatgataatttatcggtttcgctgatcgcgggtgaggggcttcccgatatagccgacgtggaattaagccggttctcgaactttctgaaggggaaggatatcccgcttgccgatctgacgccgctgattgaaaaagaccgcgataagtttgtggaagcgcgtctggccttatacagcaaaaacggaaaattgtacggccttgatacacatgtggggacgaccgtcatgttttacaacatggatatcatgaaaaaagcgggcgttgatcccgcctccattaagagatgggaagattaccggcgggcaggaaaaaaagtgcgtgaagccgctgggaaaccgatgggaacggttgaaacaaacgactccgccacattcctatccatgatttcgcagcaagggtcaggctactacagcaaaaacggaaaattgattctgaacagcaagacgaatacagatacactgaatgatgtaaaggacatggtaaatgataaaacccttctgccggctcccggcggcggccatcacagcgaagaatactacggttttatgaatcagggcggggcagcctcagtgctgatgcccatttggtacatgggacggtttatcgattatatgcctgatttaaaaggaaaaatggcgatttaccctatgccggcctggaaagaaggcggtgacagatcagcgggtttaggcggaacagccaccgtcgtgccgaagcaggctgaacatctggagctcgcgaaagaatttctcggatttgcgaaaggttcaaaggaagggaacataaagctgtggacggtgctcggctttgacccgctccgctgggacgtgtgggattcaaaagaattgaaggagaaaaacaagtacacggatttcttccggaacggtacgtcaattttttcctcgctccttgaaataaaagatgagatcaatccgatttatctgcacgaagacttctctaaagcggctgatctcgttgtcagacaggtgctgttcgatgcgctgaagacgcaggaaaaaacacctgaggaagccttggacgaggcggcagagcaattagaaaaataggagaagccgccctatttaacagtgaaagcgggggagcttttatgagacctgtaaagacagagacagcgcaaaccgtttctgcagtccggaagaagccgcgccggcgcaatgtgctgtattcaaaaaaagcggcgccttatctttttacggcgccatttatcatttcgtttctcgttttctttttgtatccgatcatcagcgtgtttatcatgagctttcagcggatactgccgggagaaattacatttgtcgggttttccaattataccgctcttcttaatccaaccttttatacggcattatttaacacattggaatataccttctggacgctgatcgtgctgattccggtgccgcttcttttagcggtgattctgaattcaaagctcgtcaggttcagaaatgtgtttaaatcggctctgtttgtaccggctttaacatcgacgatcgtagcggggattattttccggctgatgttcggagaaatgaatacgtcgcttgcaaacgagctgatgatgaagcttggcgcatcaccccaaaactggctcaacaacaaaggtaccggcatgtttttaatggtgctgcttgcgtcatggaggtggatggggattaacattctttactttctggcgggtttgcaaaatgtgccgaaagaattgtatgaggcggctgaaattgacggggcgagtacgtggaaaaagttccggcatatcacccttccatttttaaagccggtgtccgtttatgtgttaacgatcagtatgatcggcggtttcagaatgtttgaggaaagctatgtgctttggcagaataattccccgggcaatatcggcctcacgcttgtcggttatttatatcagcaggggcttgcatacaacgaaatggggtacggggcagcaatcggaattgtccttttgcttgtcatcttactagtcagccttgtttcactgaaactgtccggttcgtttaaaggggagggataagcgttgcgtaacaatcacatgttttccgtgtacagagtcgcgtttaccttgttttttatcatgctgagcctgttgtatatctttccgatgatctgtctattgctcggttcattaaagccgtcatctgagctgatgcgcatcgggctgaatctgcgtcttgatccggatgtgatgagccttgataactacacctatttgttcaacggggggagcatttattttaaatggttttttaacagcctgctgctcggcgtcctcaccacggttctcacgctgtttttttcctctttgatcggctacggactcggtgtctacgagtttaaaggcagaaatattattttcgttcttgtgctgatcattatgatggtgcctcttgaagtgatgatgctcccgttgttcaaattgacggtgggtcttcatttaatcgattcttatacgggggtgattctgccgtttattgtgtcgcctgtcgccgtgttctttttccggcaatatgcgctcggacttccgaaagatctgcttgattcagcgagaatggacggctgcaccgaattcggcattttcttcagaattatggcgccgctcatgaaaccggcattcggagcaatgatcattcttcaatctttaaacagctggaataactttttatggccgctgatcgtgcttcggtcgaaagaaatgtttacgcttccaatcggactttcagggctgctgagtccgtacggcaacaactatgacatgctgatttccgggtccgtttttgcgatactgccggtgatcatcatattcttgttttttcaaaaatacttcatttccggcctcacagtaggcggagtgaagggatagagagagggaggaaatgtaatgaaaaaagcggggattacagcagataaagaatatatcatcggtgaagtggacaaacggatgtacggatcttttatagaacatatgggccgggcggtgtatgaaggcatttatgagcccggacacccgaaagccgacaaggacggtttcagaacagacgtgcaggagttaatcaaggaattgcaagtgccgttcatccgctatccgggagggaattttctctcaggctacaattgggaggacggcgtcgggccggtgaagaaccgcccgcggaggcttgatttggcatggcagacgacagaaacgaacgaagtggggacgaatgaatttttaacgtgggcgaaaaaagtgaacgccgaagtgaatatggcggtcaatctcgggacgagaggaatcgatgccgcccggaacctcgtcgaatactgcaaccatcctgaagggtcatactggagcgacttacgaaaatcgcacggatatgaaaaaccttacggcatcaaaacatggtgcttaggaaatgagatggacggcccttggcagatcggtcataaaacggcgcatgaatacggacggcttgccgctgaaacagcaaaggtgatgaaatggacggacccgacgatcgaattggtggcttgcggaagctcaaacagcggcatgccgtccttcatcgagtgggaggccgaggtgcttgagcatacgtacgagcatgtggattacatttcactgcatacgtattacggcaaccatgaaaatgatcttgagaactatttggcgaagtctatggatttagaccattttattaaatccgtcacagccgtatgtgattatatgaaagcgaaaaaacgcagcaaaaaaacgattcacctttctttagatgaatggaatgtgtggtatcactcaaatgaagcggataaaaaagtggagccatggattacggcccggccgattctcgaagacatctacaattttgaagatgcgctgttgatcggttcactgctgattacgatgctgcagcatgcggacagactgaagatcgcctgtctcgcccagcttgtcaacgtgattgcgcctatcatgactgaaaagggcggagaagcatggaggcagccgatcttttacccttacatgcacgcctcagtctacgggagagggacttcgatgaagctgctgatcacctccccgaaatacgactcggcggattttacggatgtgccgtatgttgatgccgcggccgtttaccatgaagaggatgaagcactgaccatttttgccgtcaacaaaagcaaggaactgatggaaacggagatcaaattgagagggtttgaagattaccgcatcattgagcatatcgtgctggagcatcaggatatgaaagcaaccaatcaaaaaaacagaaaagaagtcattcctcactccaacggaacgtcttcggcaaacgctgaagggataacggcacattttactccgctgtcctggaatgtcatccgtttatcaggaaaataatgttccgaaaagccgggctgccgctgccggcttttttttacgcaaaaatcatctcctgttatctgataattgtgataatatttagaaaaagagaaaaggggctgggattaaatgaatgcgattacaatcgtcatagcgtctatatgtattttggcgatcgcctatcggctttacggtacctttatgatggtcaaagtattaaaaatcaatgatcagacaccgactccggcccatgtgcttgaggatgggaaagattatgtgcccacgaataagtgggtgtcattcggccaccacttcgcggcaatcgccgctgccggcccgcttgtcggaccgattctggcagctcagtttggctatctgcccgggcttttatggctgttaatcggagcggtgatcgggggagccgtgcacgatattgtcgtattgtttgcatcaatgcggaaaaacgggaaaacactttctgaagtcgccaaagaagagctcggcccggtggcgggcttttgcaccggtctttccatgctgtttatcattacgatcacgatggcgggtctgtccatggttgtgctgcacgcgcttgagaaaaacccgtggggaacgtttgcggtggggattacgattccgatcgcgatgggggtcggcctctactataaaaaaacgggcaatctcaaactcgcatcaactgtcgggtttcttttgttaatggccggtgttgtaatcgggccgcggctgcagacaacggctctcggggacatgctgacactggatgcgaaaacgcttgcagtggtgcttcccgtctatgcgtttttcgctgcggcgcttccggtttggcttttgcttgctccgcgtgactatttaagcagttttatgaaaatcggggtttttgccgctttgatcgcaggcgtctttttcgtcaatcccgccattaaattcccggccgtaacggagtttattcacggcggagggccggtgatcgcgggtcctgtctggccgtttatttcaataacgattgcctgcggcgccatttcgggctttcatgcatttgtcggttccggcacaacgccgaaaatgctggataaatggagtgatataaaaccggttgctttcggagcgatgcttgtggaatgtctcgtcggaattatggcgctcattgcagctgccgctcttgagcccgccgactattttgccattaacagcacgcctgaaatattccgcgccctcgggatgaatgtcgtccatctgcctgaattgagtaaagaaatcgggctcagtctggaaggaagaacgggcggagccgttacgcttgccgtcggaatgacgtatatctttacggagattccgtttttcagtcatttggcttcatacttttttcaattcgtcattatgtttgaagcggtgtttattttaacggcgattgatgcgggaacccgtgtcgcccggtacttgattcaagagtttttcggagaggtctataagccgctgaaaaaaacagactggctgccgggctcgattttctcaagcgcgctcgcctgcctgctgtggggctatcttctgtattcgggcgacatcagttccatttgggcgctgttcggcgtatccaatcagcttatggcatctgtcggcttaatcatcggtgcgaccgtcgtattaaaaatagcggataagcggcgctatatgctgacatgcctgattcctctcgcttatttgtacgtgaccgtcaactatgcgggttattggatggtgcggtatgtgtatttgaaccccgaagcggcgggatacagcgtgctgaatggcgttttatccattatcatgctcattctcgggcttgtgattatcattgcggctgtgaaaaaatgggcgaatgtatggcgtgatccgagtgccagactggaagcttcaatacccggataaatccgcggccgacccgaacattgcagcatcataaaagcagagagccgatcggtctctctgctttcggcttatgacaaatccgccgcttccaaaaggtaatccgccaaatgaaccgcgcggacacggcctgttaatccttcgcgtaaaatgccgagctgcatttgcagaaggcatccgggattggctgttacgatgacggccgcctccgtttttccggcggctttcatcttgctgtctaatattttcatagacatctctgactctgttatattataaattcccgccgacccgcagcagctgtcggccttttccatttctctgtactcagcccctttaatgcttttcaaaagcgtgcgcggttcctctgacgtatgcatcacattgcggagatggcaggagtcctgatatgtgacgatatgaggagactgcgcccgcaggtttttttgatggaacttcagatcaaccagtacggatgaaaagtctttgagcttccggacgaattgttcggcacgttccgcccatccaggttcatctttcagtaaatgcggatattcctgaagaaaggcgccgcatccgccggcgtttgtaatgatataatcagcgtcaagtgcctcaaaagcggcgatattccgcttggccagttcttttcccatctctttttctccgctgtgcccgtgaagcgcgccgcagcacgcctggccgtccggaaccgcgatttcacacccggccgcctgtaaaagcgccgttgtcgcatgatttgttgctaaaaacatcgtatccattaagcagcccgagaaaaaagcggcccgtttttggacgggacccgcggcaggaagaaaacgcggcctttccttcatgtctttccgtttcggggcgggcgggagcacttgttccattgtgcgcagatgttcaggcaaaacgcgcagcataccggtttttctgatggcggtctgcagtcccgatctttggtatattccgagaagattcacggctgcctgcatgcggttttgatgagggaaaagcccggtgaaggcggctttccgcaagaggcgcacgcccggcttatgttttttattttgatgaatgatatccctcgcttcttcaagcagctgtccgtaattgacccctgccggacaaacgggctcgcatgcccggcatccgagacacagcgaaagtgagcgctcgacatcttcatccggttcgatcagtccgtctgtgacggctttcatcagggcgatccggccgcgcggcgaatgggattcttgaaatcctgattcgatataggtcggacaggaaggaaggcagaagccgcagcgcatacagttcagcaattcaccttcatccatgcggtttttgaattctgtttgaatgtgttgctgctctttagccgttgtcatttcatcatcaccacgcgtttccttgatgaattggcgaatatttttcccggattcagcaggttttggggatcaagcgcttgtttgatcgctttcatggcggtaatgccttctgttttcagcttcatttctaaatacggcgcttttacgatgccgaccccgtgttcacccgttatcgtcccgcccagctcaatcgctttttcaaaaatggcggcaaaagctttttcgacacgttccatctcctctgtatttcggatatcggtggtgcacgtcggatggaggttgccgtctccggcatggccgaatgtgcagatggacaggccgtatgtttctgcaatctcgttaatggctttgaccatgccggcaatttgtgatctcggcacggtcgcgtcttccagaatcgtcgtcggtttcagccgggcaagggctgataatgcggaccgtctggcctctgtaagcgcgaatgcctcttcctcggtttcggccgtttggacggatacggctgctccgtttttacagatggcttcgattttttccatatctcgtctgaccgtttcgatgtcaccgtcctgttcgatcagcagcaccgcttttgcatcggtcggaagcccgatcttggcgtaatcttcaatgacctgcagtgtcggctgatccagaaattcgagtgtcgccggaatgattttttcagcgatgatggcagaaacagattccgcagccgcttcaatatgttcatagagtgcaagcagcgtttttttcgtttccggcatcggaaccagctttaaagtcgcttccgtcacaacgccgagcgtaccttctgatccgacgaaaagccgggtcagatcataaccggcgacatcctttgtcagctttcctcctgtgcggatgatatcgcctgaagccagcaccgcttcaagaccgaggacataatcccgggtgacgccgtacttcaaaccgcgcagcccgccggaattttcattaatattcccgccgatcgtcgatattttcatgctgctcggatcaggcggataaaataaccctttccgttcaaccgcatgaatcatatcttgcgtgatcacgcccggctggacggttgccgtcaaattttcttcatcgatttcaagaatgcggttcatatgtttgaataaaagcacaagcccgccttcagacggacatgtgccgccgcataagtttgtgcctgaacccctcggcacgatcggaatgttatgcctgctgcaaatcgttaatatacgggacacgtcatccgcgctgcggggagcgattaccgcatccggcatggcttgcagctgaggagccgcatcgtaagaatacacaagacggccagccgccgaatcatcataattctccttccccaccgtccggatgaacgcttcttttgcctctcgtgaaatcatgttctccaacctccctgataagaaaagcgttttcatttaattgtaaagaaaaacgattccgcacactatggagaaacatatgaaaaatgatgatatgattacgtgctttttgtatgttgatctaaaaagcggagcgccaaataaaaagccgttatgtcttcaggacggtcaagcttcatatttgtcagtgattccagtttggaaagacggtagcgcaatgtattgatatgaatatgcatgtcgtcggcggtgcgctttaacgataattgccggtcgaaaaaggcgcgcagcgtatccagaagttcttcccggccgagtacatgctcgagaacccgccgtgaaaattccgactgcgtgccgggtgcgatatcggcaatacacatatccagttttaaatcttcttcaaagacggcctgcttgtcaccgattccggctgaaagtgctttatccgcctgttcgtatgattccgcgaggcactctcccggaacgatccgtccgatgccggcggtaacaggctgcccaaaaacggcgccgatctttttgatgagctgtgttttggaagccgaatttgcttcatgattaatgagaatgcgttcatttccccagcggacaaacaggtcttcagggcattcgttctgccagagccgcccgagctcctccgctttatattgctcataacgtccttgaatgagtatgatccggcggtatgcgtgaaggtctgcaccgatgagctttgctttttctaaaaagcccggagaccattctttcagctgcagccaatcaaccataaaggattcaagcattctcgaacgccactgcgcttcttccatatggcgcgtttctttaataaacagctccgtcattttcctgagcaattctccgaaaggcaggatatcgtcagggtctcctgtcagaccgaacactccgattacctcatggcctgaaaaaacggggaggttcagtcctgcttttacgccctggaggcgtttttcatcttctttcgtaatgatgacattccgtttttcgcgggcgcagatcagtgcgccttcatgaaaccatccggcgcgcacctcattggtgcccgcgatgatcatcccttttgtatcggcaataatcacttcgcggctgtacatatgtttgacttcggcaatcaatttctttgccagttccggctgtaactgcatggcgatccccctcgccattattatacaaaaaaaaccgggtgtgccatcacccggttcatgcttattgcgcaggttttaatccgccttcaagtgttttgagcatttcatttttttctgagtctgacgcatgctgccaaagaacttcgaataagacgccgaggcccggaagcattttttcttcaccgctttggatggcgtcaacgatagtatgctccagctgatcctggttattgccggttacattagcaataacggcgttgcgtaaattaagatccattacaaccgctcctttttcctgaatgtgatacgcatattcttaccgcgcacgcggtttattatgtgctgttcttgagatataataacaacatgcatgaaaaaaggagagcacagacataaagtgaaacgaatcgactctgcaaaaaaccaaaaagtgaaggactggaaaaaacttcacacaaaaaaagagagacttaaaacgaatacatttctgatagaaggagagcatctggcagaagaagcgctcaaatcaaagggaacggtaaaagaaattctcgtaaacgatgagagcgccattccggccgatctggatatgagcattccgtgctacgtgctgagcgaagacgcgttttcagccgtgacggaaacggaaacgccgcagcggatcgccgcggtctgccatatgccggataagcggcctgatcagctgaagcggctgcttctgattgatgccgtacaggacccggggaatttaggaacaatgatcagaacggcagatgcggcgggaatcgacgccgttgtccttggtgagggaacggcagacccgtacaacggaaaaacgctgcgttcagcgcaaggatctcattttcatattcccattttaaaacgtccgcttgaggagtttaccgccgagctgaaatcacaaggcgtcgcgatctacggcacggcgcttgaaaacggtgcggcttatcaaagcgtgaagcctgaagaatcgttcgcgttaatcgtcgggaacgagggggcgggagtggacgccggccttctgcaaaaaaccgatctcaatctgtacgttccgctgtacggacaggcggaatcgctgaatgtggcggtagcggccgccatcctcgtttatcatctcagaggataggttgcgaaaaaccttggatttcactataatagatagcaataatgtaaaaaccgtgacagaggacgtcaatttttgcacacgctgccttccagggagaaaatgccgctgactgagagcatttttatcgcagcacagaaattgattttcacctctcgagttgtcaccgggaccgcgccaaacgcgcgtaaaggtgaaccggaacgatcgtttccgttatgtcaatgaagctgtcggcagatgaagtctgccttaaaaagggtggtaccgcggccacaactcgtcccttctctcaaggggcgggtttttttgttttctgaaaaaggcatagaacggtttggtttacataaaaggaggatgcatgatggaagagaagcttaaacagctcgaactggaagctgcagaaaaagtagaagcggcgggttcattaaaagaagttaacgacattcgggtgcaatatctcggaaaaaaagggccgattacagaagttctccgcggcatgggcaaactgtccgccgaagagcgcccgaaaatgggagcgctcgccaatgaagtgagagagcgcattgcagcagccattacggcgaaaaatgaacagcttgaacaagaagagatgaataaaaaactcagcagccagacgattgacgtcacgttgccgggcagtcaggtaaacatcggcggacgccatccgctgacggtcgttattgaagaaattgaagatttatttatcggcatgggatataccgtcgaagaaggccctgaagtggaaacggattattacaactttgaggcgctgaacctgccgaaggaacatccggcccgcgacatgcaggacagcttttacattacagaagaaatgctgatgagaacgcagacgtcaccggtgcagacgcgaacgatggaaaagcataaaggaaaaggccccgtcaaaatcatttgtcccggtaaagtgtatcgccgcgacaacgatgacgcgacacattcccatcagttcatgcagatcgagggtctcgtcgtggaccgcaaaatcagcatgagcgacctgaaaggcacgcttgaattggttgccaaaaaaatgttcggccaagaccgtgaaatcaggctccgtccgagcttcttcccattcacagagccttctgtcgaggtggatgtgacctgctttaagtgcggcggacaaggctgctccgtctgcaaaaaaacaggctggatcgaaattctcggcgccggcatggttcacccgaacgtgctgaagatggccggtttcaatcctgaagaataccagggttttgctttcggaatgggtgtggaacgtatcgcgatgctgaaatacggcattgaagatatccgccatttctataccaatgatgtcagattcatttcgcagtttaaacaggcgtaagaggaggatacacatgtttgtttcttataaatggttagaagattacgttgacttgcagggaatcgacccggccgtgcttgcagaaaaaattacgagagccggtattgaagttgagggtatcgagtataaaggggaaggcgtaaaaggcgttgtcatcggacacgtgcttgagcgtgaacagcacccgaatgccgacaaactcaacaaatgccttgttgatatcggtgcggaggaacccgtgcagattatctgcggcgccccgaatgttgataaaggacagaaggttgccgttgcaacggtcggagctgtgcttcccggcaatttcaaaattaaaaaagccaagctgcgcggcgaagcgtctcacggcatgatctgttcccttcaggagcttggcattgagagcaagctcgtggcgaaagaatatgcggaaggcattttcgtttttccgaatgatgctgaaacgggagctgacgcaatggcggcccttcagcttgatgatgcgattttagaattgggcttaacgccgaaccgcgccgacgcgatgaacatgcttggggtggcttatgaagtggcggctatcctcggcgcagaggtaaagcttccggaggtttcatatgaaaaagcggcagaaaaagcggcggatgctgtttccgtcaagattgaagatacgcaggccaatccgcattatgccgcaaaaatcattaaaaacgtcaaaatcggcccgtcaccgctttggatgcagacgaagctgatgaatgcaggcatccgcccgcataataacgtcgtggacattacaaacttcgtcctccttgagtacggacagccgcttcacgctttcgattacgaccggttcggttcaaaagaggtcgtcgtcagaaaagcggcggaaaacgaaaccatcgtgacgctggatgaacaagagcgcaagctgtcaagcagccatttggtcatcacaaacggaaaaaaagcgcaagccgttgcgggagtcatgggcggagccgagtctgaagtccgtgaagacaccactgcgattttactggaagccgcttatttcgacggacagaccgtccgcaaagcgtcgagagacctcggactgagaagcgaagcgagcgccagatatgaaaaaggcattgatccggcccgcgttttgctggcggctgaacgggcctgcagtctcattcaggcatatgccggcggagaagtgctctcaggcacggttgaagaaaaccatctgaaaatcgaagcaaacaacattcacgtgtctgttgaaaaagtgaacgccgtgcttggcatggcaatcgctaaagaagaaatcatcagcatttacaagcgcctcgggtttgcagtcggtgaagctgaagacgttctcgtcgtaacagtgccgtcccgccgcggagatattagaatagaagaagacctgattgaagaagcggcgagattgtacgggtatgacaatattccgtccacgcttccggaaacggccggcacgacaggcggcttgacaccgtatcaggcaaaacgccggaaagtgagacgtttccttgaaggagcgggtctttcacaagcgaccacttattcattaacgaatgataaaaaagcggccgcttttgcgatcgaaaaatcattcaacacgatgcttgctctgccgatgagcgaagaaagaagcattctcagacacagtctcgtgccgaatcttcttgaagccgtttcatacaatctggccagacagactgattccgttgctttatatgaaacgggttctgtatttctgacgaaagaagaaaacacaaaaccggttgaaaaagaacgggttgccggagctgtaaccggattgtggcgtaaaaatttatggcagggtgagaaaaagccggttgatttcttcgtcgccaaaggaatcgttgaaggcctgctgcatcaattgaatgtgtcagaccgggttgaatttgtccagtcagaacgcaaaaacatgcatcccggccggacggcaaacattctattgaacggttcgcttgccggatttatcggccaggtgcatccggcaatggaaaaagagctggatatcaaagaaacgtatgtgttcgagctagatctgcacgcgcttctgaccgaggaaacagaacctgtcgtgtatacgccgattccgaagtacccgtccgtcacgcgcgacattgcgcttgtggctgataaaaccgttacaagcggacagctcgaagccgtgatcaaagaagccggcggcgcgctgctgaaagaagtcaccgtatttgatgtgtacgaaggtgagcatatggaagagggcaaaaaatccgtcgccttctcgctccaatatgttaaccctgaacaaacattgacagaagaagaagtgacaaaagtacatgaaaacgtgctgaaagcgctggaagaaacgtatcaggcggtattaagaggataaagaaaaagcttgcagatcattctgcaagctttttttttatgaccgtttccgttctacaaggcgtttcgctttttgcgtattggcaaaatgaagtttggtgaacgttctgagcgcaccttctcccttattgatgatcagcttggcggtagcttcatcgacgtgcggccccgcgccttttggaatcgtcatcccagcctcacgggaaagcttatccatttcaattaagaaagaatatcgcgcaatgatagaggctgcggcgacggaaagatgtatgctttccgctttcgtgctgaaaaacgttttttcttttacgatatcccgtccggaaagatgcttaaaataaatgccgggctctgcaaattggtcaatcagaatcgcttccggtttaacgccgttcatttttctcagcagattggaaatcgcctgattatgaaggagcgccttcatttttccttggctcatgcctttttcctgcatctgattgtatttttcgtttttcaacacaagcaggctgtaaggaatggttttaattaacagtttggcgatttcaataatctgcggatcttttaaatccttcgaatccttcacaccgagttctttcattaaagaaagctttgttttgtcggcgtaagcgcaggcaaccgttatcggcccgaagtaatcgcctgttccgacttcatcagagccgatcactgacatggaggcaatgcccgccgggggagcgtaaaccgggtcggccgctttcttgacggttttctttgccttcggcgcctcagccgttccccagcgggccgcttctgtgccggcgttttttccttgaaagagaaccttgcccgagcggtaggctgtaatggtacagcccgggggcttggcctggaagacggcgccctgcggaacggcgggagtaagggagccggcataggattgtttcatttgttccatagcggaagcggatacttttataacagaatgggacacgatataatctccttttttggcacttttcactgtatataccagtgtatcataacagcccgaggctcgtctttccattcaaacgataatcgtggtatgataggaactaggattctcgcggaatggaggagaaacgttgtctgacggcaaaaaaaccaaaacgacagtaaacatttacggccagcacttcaccattatcggggaagaaagcaaagcgcacatgcgccatgtggccggaatggttgatgataaaatgagagaaatcaacgagaaaaatccatatcttgatataaataagctcgctgtattgactgcggtcaatgtcgtgcatgattatatgaaactgcaagaaaaatatgaaatactggagcggcagcttaaagaaaaggaatgaacaccatatgatagatatcatcatcttagttctgctcttaatgggcacattgcttggattaaaaagaggatttatcctccaatttatatacttgacgagtttcatcctctcgattgcgtttgcggcgcttttttacaaaaacctggccccgcatctgagctttatacccgcccctgatttttccggcgggcaggcggctctgtcttttattaaaggaaacgtggagacggcttattacaacgcgatcgcgtttgtcattttgtttatcatcgcaaagatcctgctccggattatcggagcggcgcttaatatcatcgccggcattccggtcattaaacagatcaacaaactgctgggcggggtgcttggatttctggaagtctatttatttgcgtttatcctgttatacgtcgcatccgtactgccggtaagcgcgcttcaggatatgctcgcacaatcgacgcttgcaaatatcatcacacatcatacgccgtatctgtcggggctcctgcaagaactgtgggcccagtacggggcataaaaaacttctcttgaccggagaagtttttttcaagctctgcgtcagttgtgccggaggagaaaaatttgtatgatgaaaagcaggaaacgactgggggttaacagtatgcataaaaaagatatcatcaggctgcttgaaacgattgcggtctatatggaactgaaaggggacaacccgtttaaaatatcagcctttcgaaaagcggcagcggcgcttgagcaggatgaccgcagcctgtcggaaatcgacgacatgatgtctttatccggaatcggaaaaggcacctacggcgtcattcgtgaatatatgcaggaaggtgtgtccggcacgcttctccaattgcagaaagaagtcccggaaggcttggttcctcttttgaagcttccgggcctcggcggcaaaaaaatcgccaagctgtaccaggagcttggcgttcatgacgcggaatcgctgaaagaagcatgcgagcagcaaaaagtacaggggctcgccggtttcggcaaaaaaacggaggagaaaatcctccaggctctcggagaagccggaaaacagccggaacggtttccgatcggctatgcgctcagcattgcctcagtcattgaagaacatttggcccggctgacggatattcagaaatattctcgggccggcagtctcagaagagcgcgggaaaccgtaaaagatctggattacattatcgctacagatcatccggaggctgtcagagaacagcttctttccctcccgaacgtaaaagacgtaatagcgggcggggatacaaaagtatcggttatcctgacctttgaatatgagacgagtgtggatttccggcttgtgacagaggaccagtttgccaccacactgcatcattttaccggttctaaagaccacaacattaaaatgcgtcagctggcgaaagagcgcggtgaacggatcagtgaatacggagtagaaaccatagaaacgggagacgtcaaaacattcccgagcgaagaagcgttttacgcccacttcggtctgccgtttattcctcctgagctcagagaaagcgggcaggaggtcgacacgtaccgggaagaaacggaccttgtggagcataaagcgataaaaggcgatctccacatgcactcagcctggagtgacggcgctttttccatcagagaaatggcagaagcgtgtatggcaaaaggctatcagtacatggcgatcaccgaccattcccaatatttaaaggtagccaacgggttaacggccgaacggctcagaaaacaggcggaagaaattgacgcgttaaacgctgaatttgaaaattttcatatttttaaaggcgtagaaatggacattctccccgacggttcgcttgattatgatgacagcgttctgtctgaaatggatcttgtcatcgcatctattcattcaagcttcagccagccggagcatgtcattatgaaacggcttgaacaggcgctgaccaataagcacgtggacattatcgcccacccgacgggacgcctgatcggcagacgggccggctatgaagtcgacatcgacatgctgattgagctcgcagccaaaacaaatacggcgcttgaactgaatgcaaaccccgcgcgcctcgatttacggactgagcatctgatcaaagcaaatgaaaaaggtgtgactttggtcattaataccgatgcccataatatcgagatgctcgatgatatgaaaacgggcgtgaccgctgcgcgcaaaggctggacagagacaaaacatgtgttaaacgcccggccgttacatgaggtcaaagcatttctgacgcgcaatgattaagtaaggaggaccataaaaccgtgcagcaaaaagtgttatcatcacttgaatttcataaagtaaaagaacagattaccgcacatgccgcctcatcgctcggcagggagaagcttctgcagctgaaacctttgacggatctcgccgacatccaaaaacagctggatgaagtcgaagaagcatccgcggtcatgcgcttgcgaggccatgctccgttcggcggcctgaccgacataagatccgctttacggcgggcggaaatcggcagtgtgctgacgccgacggaattcaccgaattgtccgggctgctgtatgccgttaaacaaatgaagcattttatcagccaaatgacagaagacggcgtcggcataccgctgatacaggcccatgcagaagagctgattacattaggcgatttggaaagggagattaactcctgcattgatgaccatggtgaagtgcttgatcatgcgtctcccgctttaaggggaatccgcacgcagctcaggacgcttgaatcaagagtcagagaccggcttgaatcgatgctgcgttcatcttccgcttctaaaatgctgtctgacaccatcgttacgattcggaatgaccgctttgtcatcccggtcaaacaggaatacagatcaagctacggcggaattgtccacgatacatcttcatccggtgctacactgtttattgaaccgcaggcgatcgtagatatgaacaactcgcttcagcaggcgaaagtaaaagaaaaacaggaaatcgaacggattctccggatgctgacggagcatacggctgaacacacacaagaaatcgctcaaaatgtggaagtgctgcagacactggatttcattttcgccaaggcgagatacgcaaaagcaatgaaggcgacaaaaccattcatgaacggagacggctttatccgtctgaaaaaagcgcgccatccgctgctgccccaagatcaagtcgtggccaacgatattgaactgggcggagattattcaacgatcgtcatcacgggaccgaatacgggcggtaaaaccgttacgttaaaaacactcgggctgctgacgataatggcgcaggcaggattgcacataccggctgacgagggctcggaagcagccgtatttgacaatgtgtttgccgatatcggcgatgaacagtcgatcgaacaaagtctgagtacgttctcatctcacatggtcaatatcgtcaatattttaaaagacgtgtctgaaaacagtcttgtgctgtttgacgaactcggtgccggaacagatccgcaggaaggggcggcgcttgccatgagcatccttgacgaagttcaccggacaaacgccagagtgcttgcgacaacccattatccggaactgaaagcatacggatataacagacaaggcgtcatgaatgccagcgttgaatttgacattgaaacgctttcgcctacctacaagcttctgatcggagtgccgggccgaagcaacgcatttgaaatctcaagacgccttgggcttccggagcatatcatcggccaggcgaagtcagaaatgaccgccgaacataacgaagtcgatctgatgatcgcatcgcttgaaaaaagcaaaaaaagagcggatgaagagctttctgaaaccgaatcactcagaaaagaagcagaaaaactgcacaaagagcttcagcagcaaatcattgagctgaacgcccaaaaagataaaatgatggaagaagccgagcggaaagctgcggaaaaactggaagccgccgcaaatgaagccgaacagattatccgcgagctcaggtccatcaagcaagaacacagatcctttaaggaacacgagctgattgacgccaaaaaacgtctcggagacgcaatgccggcttttgaaaaatcaaagcagccggaaagaaaaacagagaaaaaacgcgagctgaagccgggcgacgaagtaaaggtgctcacattcggacaaaaaggggcgctgcttgaaaaaaccggcgagaaagaatggaacgtccaaatcggcatccttaaaatgaaggtgaaggaaaaagatcttgagtttctcaaatcggctcctgaaccgaaaaaagaaaaagcaatcaccgccgtaaaagggaaggattatcacgtatcccttgaacttgacctcaggggagagcgttacgaaaacgccctcagccgcgtcgaaaaatatttagatgacgcggtgctcgccggctatccgagagtgtccatcattcacggaaaaggcacgggcgccctccgaaaaggggtgcaggatcttctgaaaaaccaccgcagcgtgaaaagctcgcggttcggggaagcgggagaaggaggatcaggcgtaacgattgtcgaactaaaataaaaagggagaaaacgtcatgaatgctttttgggaaaatgagcttgttgaaatcgcggcttattacagtgttgccgtcttgtgtctcgtcatttttctgaccgtgtttgaattggtgacatcctataaaaactgggtggaaatccaaaaaggcaatcttgcggtggcaatggcgaccggagggaaaattctcggtatcgcaaatgtctttcagcacagcatcgcccagcataattcgcttttgcaaatgatcggctggggcgtatacggatttattatgcttttaatcagctattttatctttgaatttctgacgccccggtttaaaattgataaagaaattgaaaaagataacagagctgtcggctttatttcatttgtcatctcagtcggcctgtcatttgtggtggccgccgggatttaaggggacggggaaaaatggagaagcttgcgaaagtgctgctgtcggcagcggggatttttctgttcatcggacttatttatctggtcatgacatcttaatactgaaaaaaggctgccgaactcaaatcggcggccttttttattgagaataccagtttatgcaggccgtatcagagcaaatgacggactcccaattcatggcgcggacgacagactgaatgtcttgttcttccatgagaaagagtgtcgtaaaagaatcatatatgctcataaaagcggcgcgccgtttttcatcggcaatgatcatgtcagcccgcagcagtccgcatacatccgaatccgtcgtttgattgagtgaaaataggcctttctcttcgacaggctcataataaatgcagcgctttatgccttttgaacggaacacatccaaaagtcccggaatcaaaaatggcgaagtgacatcatcgctcggcaagtacagatcggatgatggagccgatttaaccgctcggcggattcaggatgtgcatattccccccgcaatgccgtgacagcagtcataagcgcaagcgccgtttctttttcagaacgcaggccgcaaatgctcatgacggtttgccaggaaacgggtctgcccatcgcgatgatctcctcatcactcggatacatatgttcataaggccgtttgcgcttttgctcttcccgaccatccggcatccggacaaagggatggagcaaaaaggcggccgacgtaaacggcttcggcagctggcgcaggataggaactccctcttcaaaatgcagcgtttccagcaaactcaacacctcctgaaactcgaaatttcacatgaaacgctttcccattccaatcacccttctgctataataatagcgtataggaaaacagaagggagaggtattatgcagtctgaaaagccatggctttctcaatatcccgaagagattccgcatgagcttgaatttaccgatcaaaccctgccatccaatctgacaaactccgcagctcaattcccgaaccataccgccatttattttctaggaaaaaaactcacattccaagacgttctcacagattcattaaagcttgccgcttttttacgcaaaacaggcctgaaaaaaggtgacagagccgccattatgctgcccaattgtccgcagtcggtcatcgctttttacggcgtattgtttgccggcggcattgtcgttcagaccaatcctctctacacggaacacgagcttgagtatcagctgaaagacagtgcgccgcgcgtgatcatcaccctcgatatgctgtttccgaaagtgataaaaatgaaaacgttatcactcgtcgaacgcattattacaacaagtataaaagactttttgccgtttccgaaaaatatgctttatacgctcacgcaaaagcaacaggtgcatattgattatgacggctgcgaacaaattcacaaattagcggatattttaaaaaacgaaaaagcggaggaagcagagccatttgatattgaccctgcgcatgacatcgccgtgcttcaatacacgggcggaacaaccggctatccgaaaggcgtcatgctcacacaccgaaacattcaggccaatacagaaatgtgcgccgcctggatgtacaaaatgaaaaagggagccgaaaaggtgctcggcatcgtgcctttttttcatgtgtacggattgaccgccgtgctcaatttttccattatgcagggatgtgaaatgatccttcttcctaaattcaatcctttggatacactgaaaacaatcgacaggctgaagccgacggttttccccggggcgccgacgatttacatcgggctgctgcatcacccggagctgaataagtatgatctgtcctccattgaaagctgtccgagcggttcagcggcactgccggttgaggtcaaacagaaatttgaaaaagtgaccggaggaaagcttgtggaaggctacggattatccgaagcatcaccggttacccattcaaacttcatctggggaaaaaataaacccggcagcatcggctgtccctggcccaataccgatgcgggaatctattcagaagaaaaaggcgggcttgcggagccgtatgaacacggcgagctgatcgtaaaaggccctcaggtcatgaaaggctattggaataagcaggaggagacggcgcgtgtcatcagagacggctggctgtttaccggagatatgggatatatggatgaggaaggatttttctacatcgccgacaggaaaaaagacatcatcattgccggcggttacaacatttacccccgggaggtggaggaggcgctttatgagcatgaagccgttcaggaaatcgtggtagcgggcgtccctgattcctacagaggggaaacggtgaaagcatttatcgttttgaaaaaaggcgccgaggcagatgccgatgagcttgatgcgtttgcaagagagcggcttgcgccgtacaaagtcccgaagctgtacgaattcagaaaagagcttccgaaaacggccgtcggaaaaatattaagaaggcgtttagtcgaagaggaagatgcttcccatgaaaacaaggtgccttaaaagaaaaacttgacaaaatccggattcctttttatcatgaagttatgaatgaatagtcattcatttatcgaaggaaggaacgatgacattgaaccaaaaacggccaaagtatatgcagattattgatgcagcagtagaagtcatagcggaaaacggctatcaccaatcacaggtgtccaaaatcgccaagcaggccggcgttgcggacggcaccatctatttatatttcaaaaacaaagaggatatactcatttctctttttaaagaaaagatgggccagttcattgaacgcatggaagaagaagtgaaagaaaaaacgacggcaaaagaaaaactcgctctcgttattaagcagcatttcacactgctcggcaatgaccgccacctcgcgattgtgacccagcttgagctcagacagtcgaatatcaagctgcgtctgaaaatcaatgatattttaaaaggttatttaaacatgctggacaccattttgaccgaaggaatcgagtcgggcgaatggaaagataatctcgacgtccgcctcgcccggcagatgatattcgggacgatagatgaaacagtgacaacatgggtgatgaacgatcagaaatatgatcttccggatttgtcagacaaggtattggagctgttggtgtcagggattcatcaaaactaaagggggttgacggatgaacagcctttcgatggcggtagaacaatctgttgcggtgatcaccattaatcatcagccggccaacgcgctgtccggcgcggttttagatgagttgtccggtctgttcgaccgctgtgaaacagatgacagcgtcagaagcatcattattcgcggtgagggggaatttttctcggcgggcgctgatattaaggaatttacgtcgcttgaaaatcttgagcaatcttctgccatggcggataaaggccagcagctgatggaaagaattgaagggtttccgaagcccgttatcgcggcgattcacggcgctgcgttcggcggcggccttgagcttgccatggcctgccatatcagaatcgctacattagatgcaaagctcggcctgcccgagctgaatctcggcattattccgggctttgccgggacgcagcggcttccccggtacgtcggtacggcgaaagcgcttgaaatgatcggcacttcagaacctgtaaccggagaagaagcgctcagcctcggtcttgtcacgataggcgccgaacatgaagaagagctgctgcaaaaagcgaaaacgctcgcgggcaagtttgcggaaaaaagcccgcagtcgatggcttctctgcttgagctcctttattcaaacaaggtctattcttatgacggcggcttaaagcttgaagcaaagcgctttggggaagcatttgcatcagatgacgcaaaagaaggcattcaggcatttctcgaaaaaagaaagcctcaattcggtgggcgaagataaaggggataagaatatgaatctatttgtactgatgaaacggacgtttgacacagaagagaaaatcgtcattgaagcaggaaagattcaggaggacggggccgaatttatcattaatccgtatgatgaatacgccattgaagaagccattcagctgaaggaagagcacggcggaaccgtgaccgccgtaaccgtcggcggagaagatgcggagaaagaactgagaaccgcccttgcgatgggctgtgaccaggcggtgttaatcaatattgaagatgatctgagcgatcctgaccaatactccgtttcaactatcttatatcattatttcaaggaccgggaatatgatctgattctcggcggaaatgtcgcgattgacggcggttccggccaagtggctccaaggcttgccgaactgctgaacattccttgcgtcacaacgattacaaaactgacaatcagcggcgatgaagctgtggcagagaaagacaacgaaggggataccgaaatcattaaaacctcacttcctttagtcatcacggcacagcaaggcttaaacgagccgcgctatccgtcgcttccgggcattatgaaggcgaagaaaaaaccgctggaagaacttgagttcgatgatctcggcattgatgaagatgatgccgcaccgaagctcaaaacgatcgaacgttttctgccgccgcaaaaagaagcgggcagactgatcgaaggagaagccgctgagcaggcgaaggagcttgtatcactgctgagaaaagaagccaaagtcgtataaactgatattaaagaaactgggggatgtcagaatgggaaaaaaagtgatcgtactcggagaaattcgtgacggcgccttacggaacgtcacctttgaagccatagccgcaggcaaaaccatttccggcggaggagatgtcatcggcgtgctgatgggaaagggcgcggctgatgcagcatcagaactcattcagtacggcgccgacaaagtatttacggccgattcgccggggctttctcagtatacggcggacggatatgccgcaattctcggggatttgatcgaaaatgaaaagcctgatgcggtcattttcggccacacttctatgggaaaagatttgtcacctaagcttgcggcccggtttgaaacggggctgatttcagacagcacggatgtaagcgttaccggagataacatcgtttttacaagaccgatctattccggcaaagcctttgaacaggtgatttcaaccgatcctttcattctggcgacaattcgtccgaataatattcaggcattagaaaaagacgcgaaccggacgggtgatattgaagagcttgcggcgcctccggcagatttgcggacggtcattgaagaagtagtcaaaaaaacggcggacggcgtggatttatcagaagcgaaaattatcgtagcaggcggccgcggtgtaaaaagcaaagatggatttgaaccgttaaaagaacttgccgaggtgctcggagcagcggtgggcgcttcgcgcggcgcatgtgacgcggactactgcgactattctcttcaaatcggccagacgggaaaagtcgtcacgccggatttgtatatcgcctgcggaatttccggagcgattcagcatttggcgggcatgtcaaacagtaaggtcatcgttgccattaacaaagacccggaagcggaaatatttaaaatagcggactacggaattgtcggcgatttgttcgaagtggttccgcttctgactcaggaatttaaaaatgccaatattcattcataatcaaaaccctctggcttatttgtcagagggttttggtttgtgttaattagttcgtacaaattatagattaataaaacaacagattgacatgtacgaaccaatgtaataagcttttgtaaagcgcttacaaacttatccatacagcatacatcccagatagatcggctgtagtgctttcattcttattaaggggaaggaatgatcaagtttgtctcacaatacggcagtcattcaaactgatatcacacggggaaccattaataaaaacatatacggacatttcgcggaacacctgggaagaggcatatatgagggcatctgggtcggaaaagattccgatattccgaataccggaggggtcaggacggatgtcgccgctgccctcaagcagcttcagattcccgtcctcagatggccgggcggctgttttgctgatgaataccattgggcaaacggcgtagggaaacgcaaaacaatgctgaatacccattggggcgggacgattgattctaatgaattcggcacgcacgagtttatgatgctttgtgaactgctcggatgcgaaccgtacatcgccggaaacgtcggcagcggaacggttaaagaaatggctgattggattgaatacatgacgtttgaagcgggcacgccgatgtccgactggagaaaagaaaacgggcgggaaaaaccgtggaagctgaaatatttcggaataggaaatgagaactggggctgcggcggaaacatgcatcctgagtattatgccgacctttacagaaacttccaaacctatgtccgcaattacagcggtaatgaaatctataaaattgccggcggcgcgaatgttgacgattaccgctggactgaaactttaatgaaaaaagccgcggatctcatggacggactgagcctgcattattacacaataccgggcgacttctggaaggggaaaggatcagcgacggagtttacggaagatgaatggttcatcacgatgaaaaaagcggcgcatatggatgaattgatcacaaggcacagcgccatcatggatcagtacgatcccgaaaaaagagtcgggctgatcattgatgaatggggcacgtggcttgatcctgagccgggcacaaatccgggctttctgtatcagcagaatacgatccgcgacgcccttgtcgccgccgcgcattttcacatttttcatcagcacgcagaccgcgtacagatggccaatatcgcgcaaaccgtcaacgtgcttcaggcaatgatcctgacagaagggaaagaaatgctgttgacgccgacgtatcatgtgttcgatatgtttaaggtgcaccaggacgcatctcttttggcggcagaaacaaatgcagccgggtacgaatggaatgacggccggctcccgcaagtcagcatttcagcgtccaaacagcaaaacggagacatacatatcagcatttgcaatatcgatcatctgcacaaagctgacgtgaagattgaactgcggggcatgaaaaagacagggacgccttcgggaacgattctgcacgcggaaaaaatgaatgcccacaatacattcagcagtccggaaaacgtcaaaccgaagccgttttccgggtttgctcaaaagggaggaaaacttgaggcggagcttcctccgatggcgattgtattaatcacgctgcctgcaggtccatcttaagttttgaacgcccgccgcccggttataatacactgtataaataagattatttccggcgggttcgggagaaaataatataagcattaaattagcatgaacgaatgggagatgctatactaaaaatcatcatttgacaattggaggaataacaaatggctatcgtaaaagcaactgatcaatcgttctcagctgaaacaagtgaaggtgtcgtattggctgatttctgggctccttggtgcggaccttgtaaaatgatcgcgcccgttcttgaagagcttgatcaagaaatgggagacaaactgaaaatcgtcaaaatcgacgtggatgaaaaccaagaaactgccggtaaatacggcgtcatgagcatcccgacacttctcgtgctaaaagacggagaagtcgttgaaacatctgtcggcttcaaaccgaaagaagctcttgaagagcttgtaaacaaacatctgtaagccgaaaacttccgttacggcagggcgattcctttgaaagggaatcgccttttttgatcttccaaaagctgagaatggagaaaaacaaatgttcgtgatacactgaatggacacgagaaatgaatgtaaggaagggtaacgtatgaataaacaactgaaagaaaagctggccctccttcccgatcagccgggctgttatttaatgaaagaccgtcaaaaaacagtcatctacgtggggaaagcgaaagtcttgaaaaacagggtgcggtcttatttcaccggttctcacgacgcgaaaacccaacggcttgtgacggagattgaggactttgaatatatcgtgacttcctccaatcttgaagcgcttattttggaaatgaatctgattaaaaaatacgatccgaaatacaatgtcatgctgaaagatgataaaacctatccctttattaaaatcacccatgaacgtcatcctcggctgattgtcacccggaatgtcaaaaaagacaagggacgctatttcggcccgtatccgaatgtgcaggcggcgcgggaaacgaaaaaactgctggaccgcctttacccgctcaggaaatgctcaaagcttccggaccgcgtctgtctttattatcatctcggccaatgcctcgccccatgtgtaaaggatatatctgaggagacaaaccgcgagattgttgaagacatcacccgttttttaaagggagggcataacgaaatcaaaaaagagcttgaagcgaaaatggcagaagcggccgaaaagcttgaatttgaacgggctaaagaattccgcgaccagcttgctcacatcgaatcgacgatggagaagcagaaaatgaccatgaatgaccttctggaccgcgatgtgtttgcatatgcctacgataaaggctggatgtgcgtccaagtcttttttatacgccaaggaaaactgatcgaacgcgatgtcagcatgtttccgatgtatcaggaagcggatgaagagtttctgaccttcatcggccagttctattccaaaaacaatcactttctgcctaaggaaattctggtgcctgacagcgttgacagggacatgatcggcgagctgttggaaaccgccgtgcatcagccgaaaaaaggtccgaaaaaagagctgcttttgcttgcgcacaaaaatgcgaaaatcgccctgcgggaaaaattctcgttaatcgagcgggatgaggaacggtcaatcggtgcagccgaacggctcggcgaagcactgaatatttacacgccgcatcggattgaagcgtttgacaactccaatattcaaggcacaaaccccgtatcggccatgattgtctttattgacggaaaaccgaataaaaaggaatatcgcaaatataaaattaaaaccgtaacagggccggacgattacggctcaatgagggaagtcgtcagaagaagatacacgagggtgctccgcgaaaatcttccgctgccggatttaatcatcattgacggcggaaaagggcagattaacgcggcgcgcgacgtgctcgagaatgagctcggccttgatgtcccggtagcgggactggcgaaagatgataaacaccggacatcgaaccttttgatcggcgacccgcttgaaccggtgtttctggagcggaacagccaagagttttacctgcttcagcgcattcaggacgaagttcaccgttttgcgatcagctttcacagacagatccggggaaaaagcgtctttcaatccgttctggatgatatccccggaatcggcgaaaaacgcaaaaaaatgctcttaaaacatttcggatctgtcaaaaagatgaaggaagcaagccttgacgatatcaaaaaagccggtgtgccggccgcggcggcccagctgctgtttgaaaaattaaaaaaatagtattgtgcttttctgaaaaatctgctagaatgtgaactaatttcataagatcgtgttatatggtgaagatagaggtgcgaacttcaatagtaagcctttggagaatgatggattctgcgaaaaaggctgaaaggggagcgtcgccgaagtgtgtcacatcccatcggtgtgatttgctggccttgcattaaataaatgtaaggctgtcaagaattcattttcttggagggctatctcgttgttcataatcaatcgtactgatatgaaaagcaatgagagctattcctctcattgctttttttattgtggacaaaacgctctttgctcctcacccgcacgaaccaaaatgtaaagggtggtctagtatgggtcttatcgtacaaaaattcggaggcacttccgtcggctctgccgaaaaaattcaaaatgccgcaaatcgcgccattgctgaaaagcaaaaaggccatgatgtcgtagtcgtcgtttcggcaatgggaaaatcaaccgacgcgctcgttaacctcgcggctgaaatcacatctgaaccaagcagacgcgagatggatatgcttttgtctacgggggagcaggtcacgatttcgcttttggccatggcgcttcaggaaaaaggatatgacgccgtctcttatacgggctggcaggcgggtgtccgcacggaagccgttcacggcaatgcgagaattacggatattgatatcacggcgattcgttcgcagcttgcagaaggcaaaattacagtcgttgccggttttcagggcgtaacggaagacggcggcatcacgacgctcggacggggcggttctgataccacggcggtcgctcttgcagcagcgctggaagcggataaatgcgacatttatacagatgttccgggcgtatttacgacagatccgcggtatgtccggtcagcgagaaaactggcggggatttcttatgatgaaatgctggaacttgcaaatctcggagcgggtgttcttcacccgcgggcggttgagttcgcgaaaaactaccaagtgcctttagaagtgcggtcaagcacggaacatgaagccggaacattaattgaggaggaatcatcaatggagcagaatttaatcgtcagaggaattgcatttgaagaccagatcacaagggtgtccgtcacgggccttgcaagcggactgacaacactttcaacaatcttcaccgcgctggcaaaacgaaacatcaacgttgacatcattattcagacacagtcggatgatggggaagcggatatttctttctcagtgaaaacggaagatgccgcccaaacggtcgccgtgcttgaagaatataaaaacgcgcttaactatgaaaaaattgaaaccgaaagaaaactggcgaaagtctccattgtcgggtcgggcatggtttcaaatcccggcgtcgccgcggacatgtttgccgtactggcggaaaaaaatgtacaagtcaaaatggtaagcacatccgaaataaaagtatcagcggttgtcagcgaaaatgatatggtgaaagcggtcgaagcgcttcatgatgcgtttgagctgtctaaacagccgtctgccgtataaacgggcaggcaaaaaggcgggacttttgagtcaccgcctttttcaattatacagggtccttcatatcccattttacagtcaggacgactttatccgctctcttttttacctgttcataagattctgcaatctgatcgttcatcaattgaatctgttcggctataaaaccggcttcaagctggaaacaaggctctttctgatgtttgagcctgctggatacgagcggtccttccagttcaaattccagttcttgttttttcgatcctgcgtttgtcaaagttccccagccggctttttcaaaaaaggcggggatttcttcccacgattgaagaggaaatttgcgggcgaggcgttttcccgcccaatacatcatcgatgaatgatccggaccgaggatatccggaagcacgatttcccggattaattcgtagccgtatgcgctgacgtcgagttcagttaaaggttctaaagctgcttcataattattcttcatattatgtattcccctctctccttcgtttattatagcttaaacaggggggaggattacaggatgatcctataaaacacgcgaaaaaatgtgagaaagatatcgcaggaaaataaaattttccctccagataatcaattccgaaaattataatttatgtacacgttttcttgacgcccttttgagggaggagtaaaatgaaattgtcaataaattttaataaagtgcttacaattgaaacgaagtgggggcagagattttagtacatttcgcacttaaatcaaacagggggtaaagtaatgtctgggaacagagagttttattttcgaagattgcattccttgctcggtgttattccggtcggcatctttttgatccagcatttagtcgtcaaccaatttgccgcaaggggagcggatgcgtttaacaaggcggccggctttatggacagtctgccgttcaggtatgcgttagaaatttttattattttcttacctttaatttatcatgcggtttacggtgtgtacatagcatttactgcgaaaaacaacgctggccactacagttatttcagaaactggatgtttgtgcttcagcgtgtcactggtattctcacccttattttcgtcagctggcatgtgtggcagacgcggattgccgcgcagatgggcgctgaagtcaacttcgatatgatggcgaatattctgagctcgccgtttatgctcggtttttacattgtaggcgttttatcggtcattttccacttttcaaacggcttatggtcttttgcggtcacatgggggatcacggtcacgccgcgttctcaaagaatttcgacttacgtgacgctgattatatttttagcgctttcatacgtaggtttaaaagcgatttttgcgtttgtgtaagagaactagattactagagggagaggggctatcatgagtcaatcaagcattatcgtagtcggcgggggtcttgccggcctcatggcgacaattaaagcagcggaatcaggcacggccgttaaattgttttccatcgttccggtcaaacgctctcactcggtctgcgcgcagggcgggataaacggagctgtcaacacaaaaggggaaggagactctccgtttgagcattttgatgacacggtatacggaggcgactttttggcaaaccagcctcctgtaaaagcgatgtgtgaagcggcgccgtccattatccacttattggaccgcatgggggttatgtttaacagaacgccggaagggctcttggacttccgccgtttcgggggtacacagcatcacagaaccgcttacgcgggagcgacgacgggtcagcagcttctttacgcactggacgagcaggtgcgcagatatgaagtggcgggtctcgtcacaaaatacgaaggctgggaattcctcggcgccgttcttgacgatgagcgcacgtgccgcggtatcgtagcccaaaatctgaccaatatgcaaatcgagtcattccgttctgacgccgttattatggcgacgggaggacccggaatcgtattcggaaaatcaacaaacagcatgatcaatacgggatctgccgcatcaatcgtctatcagcagggcgcttattatgcaaacggcgaatttatccaaattcacccgacagcaatcccgggggacgataaactgcgtctgatgagtgaatcggcgcgcggcgagggcggaagagtctggacgtacaaagacggaaaaccttggtacttcctcgaggaaaaatatccggcttacggaaacctcgtgccgcgggatattgcgacacgtgaaatctttgacgtgtgcgtgaatcagaaactcggcatcaacggagaaaacatggtgtatctcgatctgtcgcacaaagatccgaaagagcttgacgttaagcttggcggcattatcgaaatctatgaaaaattcatgggcgatgacccgcgcaagcttccgatgaaaattttccctgccgttcactattcgatgggcggactgtgggttgattatgatcagatgacaagcatccgcggactgttcgcagcgggtgaatgtgactattcaatgcacggaggaaaccgtttaggggcgaactctctgctttccgccatctacggaggaatggtggccggaccgaatgcggtgaaatatgtttccggacttgaaacatcagcggaagacctgtcttcttcattatttgattcctatgtgaaaaaagaagaagaaaaatgggccgatatcatgaagatggacggcgacgaaaatgcctacgtgcttcaccgtgagctcggagaatggatgacggccaacgtcacggtggtccgccacaacgacaagcttttgaaaacggatgacaaaatccaagagctgatggaacgctttaagaaaatcaatatcaacgatacgacaaaatggagcaaccaaggggcgatgttcacccgccagttctccaatatgcttcagcttgccagagtcatcacgctcggcgcatataaccgaaatgaaagccggggagcgcactataaaccggatttccctgaaagaaatgacgatgagtggctcaaaacgacgatggctaaacatgccggtccgtttgaagctccggaatttgaatatcaggatgtcgatgtatcactgattgcgccccgtaaacgcgactactcgaagaagaaggtggcgaaataatcatgagtgagaaaaagatacggtttatcattacacgccaggatacgcccgaaagcgcgccatacgatgaagaattcgaaatcaattaccgcccgaatctgaacgtgatttccgccctgatggaaatccgcagaaatcccgtgaatgcaaaaggagagaaaaccactccggtcgcatgggacatgaactgtcttgaagaagtatgcggcgcctgctccatggtcatcaacggaagaccgcgccagtcgtgtacggcgctgattgataagctggaacagccgatccgtctgaagccgatgaaaacattcccggttgtccgtgaccttcaggttgaccgcagcagaatgtttgattcactgaaaaaagtgaaagcatgggtgccgattgacggaacttacgatttggggccggggccgagaatgccggaaaaacgccgccagtgggcatatgaattgtctaaatgcatgacatgcggcgtctgccttgaagcctgcccgaacgtcaacagcaagtcgaaattcatggggcctgccccgatgtcacaagtgcgtctgtttaatgcccatccgacgggcgcgatgaacaaagcagaacgtttagaagctttaatgacagacggcggcctcggagattgcgggaattcacaaaactgtgttcaatcctgcccgaaaggcattccgcttacgacttcaatcgctgctttgaacagagataccaatttacaagcattccgtaatttcttcggaagcgacagagtataagaaagagaaaaagagcctcttccgcacgggagaggtttttttataaggagctgaaggtgatgaaacaaccgcaatatattgatatcccgtttgaagaatggagacagtcgttttctttctttactgaagtatcggttcgtttttcagaaacggatatgttcggccatatgaataatgtaacccctttcatctattttgaagaagcacggatcgcttattttaaacagcagggcatgacggcgcaaaactcggaaacgatgacggtcgtcgcaagccagcagtgcgactatatgcgtcaggtgatgccgtatgaaaatctgcggatttatgtgaaagcaagcgctgccggaaatgcgtccgtcacccttcattaccttggagaaaatgagtcgggcctgccgtgctttacaggttccgtcgttatggttcaagtgtcgaaaaaaagcggcaaagcggtcagctggacggagcgggagaaaggcattctgctcgcctgaacggataactatttctctaagagacgtcacctccgaagcgccctttacatatgatatcttgactatataaacccattcgtttcagattcgctctcaccttagcaaggagggttacaatacttgaaggagaaagattttcaatcaaagccgctgctgaccaaaagagaaagagaagtattcgaattgctcgttcaagacaagacaacaaaggaaattgcaagcgagctatttatcagtgaaaaaactgtacggaatcacatttcaaatgccatgcagaagttaggtgtgaaagggcgttcgcaagctgttgtcgagcttcttagaatgggtgagctagagctctgattcttgccggttttccttctttacgagaaggagccggttatttgcgttggcgcccgggctgatgggcatgcggtgaaaatcccggtttttcctttttctccgtcagtcttgcattttcttaaaaaaagaaggaaaatagacacggagcgcatagcccagaaagatccttgagtgagggatggacaaatgacatcaaaatctgtagagcatgttgcggatatcgaaaaatcactccgccatatcgctgcgatcattaaacaaaaaggaagagaaatccttaaccaatatgcaattacaccgccgcaattcgtggggcttcaatggctttatgaattgggggatatgacaataggcgaattatcaggcaaaatgtatttggcttgcagcacgacgacggatctgatagaccgcatggaaaaaaataagcttgtcgagcgggtcaaagacccggctgacagacgggtcgtcagaattcatcttctcgctgaaggagagcgcattatccaagaagtgattttgaaaagacaggcttatttgcgggatatgtttgcgacattttccgaagaagaaacagccgctttcgaaaaatcattattgaaactgcagcatgaaatgaaaagaaaatgaggcgattttgttggaacagccgataggagtcattgattccggggttggcgggttaaccgttgctaaggaaatcatgagacagctaccgaaggaaaatatcatctatgtgggagatacaaaacgctgcccgtacggcccgcgtcctgaagaagaagttcttcaatacacgtgggaaatgaccgattacctgctggaaaaccaccatatcaaaatgctcgtgatcgcctgtaatacggccacggccattgccttggaggatattcagcgcaaaacggatattccggttgtcggcgtcattcagccgggtgcgagaacggcgataaaggtcacgaaaaaccagcatatcggcgtcatcggcacggtcaataccattaaaagcagagcgtatgagcaggcgctgctcgggttaaacgcagaacttcaagttgagaacacggcttgtccgctgctcgtgccgtttgtggaaagcggacggtttcttcaggaatcagcggaggaagcggttgaagcatcgcttgaacctttaaaaggtacatcaattgacaccttgattttaggatgtacgcattatccgattttaaaagacccgattcagaattatatgggagagcatgtgaaaatcatttcctccggagacgagacggcgagagaagtgagcaccatcttgtcttataaaggtttgttaaaccaatcgaaacatgcaccggagcatcaatttcttacaacgggagagcggaacggcttcgcaaaaattgccgaagactggttcggccacgaaatcggccatgtcgagtgcatctcccttcaagagccggtcagaaaataaatcaaaaaaaccccgctgtttacagcgggtttttttgcgcttcccggtctatttcccggacagggctcgtatacatcatagtacaaacagccttaggagggaaaagtatgctgaaaaaaggacctgcagtcattgctgcaacatgtcttacttcggcttttgtgttatctggatgcggtttgtttcaatccgataaaacagccggggaaattgacccgcctcaagacatttcatatgtaaaggatgaagcgggaattcaggcaaaaccaaagcagtcagagaaaaacggcatttctaaagccgaccagccggccaatacagtcatgcgagaactgtatctgattgataaaaacggctatgtcgcagcacagacactgcctcttccaaacagtgagggaaccgcaaagcaggcccttgagtacttggttcagggagggcctgtatcagaaatcctgccgaacggcttcagagcggtgctccctgcggatacgacggtaaatgtcgatattaaaaaagacggcactgccgtcgctgatttttcgaaggaatttaaaaactataaaaaagaagacgaacaaaaaatcctgcaatcgattacatggacgcttacccaattcagctcaatagataaagtcaaaatcagaatcaacgggcacgagctgaaagaaatgcctgtgggcggcacgccgattacgggcgacttaagcagaaaagacgggattaatattgaaacggccggagtgaatgatctgacagacacccacccgctgactgtatattatctggcggaaacagagacgagcgaatactacgtgcctgtcacaaagcggattgacaattcggaaacaaatgacatcaccgctgccgttgaacagctcgccgacggaccgggcaaagcaagcgggcttttgacggactttaataacgatgttaaacttctcagcaagccgaaagtgaaagacggccaggttacactggactttaacagctctatttacggaagcgccgacgaaaaaacaaaaatggtgtcatcgggcgtactggacagcatcgttctcacgttaaccgaacagccgtcgattaaaagtgtttctataaaagtaaacggaaaatcagaactggtgaatgaaaaaggagaatccctttcaaaacctgtttcgaggccggcacaagtgaatacgggtagtttttaatttgcgatttttgatatactagtaaaaaagaggttagcgttccggctgcctctttctttattcacaatccggaacaaaaggtttatgtacatataatcggaggtaaaatatgagacacgatggaagacagcacgatgagctgcgccctatcacatttgatttggattttatcactcacccggaaggctctgttttaattacagcgggaaatacaaaggtcatctgtaatgcatctgtggaagaccgggtgccgccatttttacgcggcggaggaaaaggctggatcacagcggaatacagcatgcttccccgcgcgacgaatcaaagaacgataagagaatcttcaaaaggaaaggtctccggcagaacgatggaaattcagcggctgatcgggcgcgcgcttcgggctgtcgttgatttggagaagctcggcgaacggacgatctggatcgactgtgacgtcattcaagctgacggcggaacaagaacggcttccattaccggcgcattcttggcaatggcccttgcgaccggcaaactcgtaaaaagcggcgttatcaaaacctctcccgtgacagattatctcgcggccatttctgtcgggatggataaagaagaaggccttcttttagatctgaattatgaagaggattcggcggctgaagtcgacatgaatatcatcatgacgggaagcggacgttttgtagagcttcaagggacgggcgaagaagccacattctcccgtgaagatttaaacggactgttaagccttgccgaaaaaggaatccagacgcttattcaaaagcaaaaagaagtgctcggagaaacattgcctgaactgaaataagaaagagaggcctgatcagcgtgaaagaagccattattgcgacacacaatcagggaaaagtgaaagaattcaaggaaatactcgaaccgaaaggctacagtgtctcttctttggcggaaatcggatttacggaagaaattgaggaaaccggacatacctttgaagaaaacgccattttaaaagcggaagccgtggcaaaagccgtcaacaaaatggtcattgcagacgactccggtttatcagtggacaaccttggaggcagaccgggcgtttattcagcccgttacgccggagaagcaaaagatgataaggcgaatatggataaggtgctgtcagaattaaaaggcatcgaaaaagagcagcgcacggcccgtttccgctgcgcccttgccgtcagcatgccggggcaggaaacaaaaacggtcgaaggtcatgttgaagggtatattgcagaaggacccgaaggagataacgggttcggctatgatcccatttttattgtaaaagataaagataaaaccatggcccagctgacaagcgctgagaaaaacaaaatcagccacagggctgaggcgctcaagaaactgtcaaagctgcttgattcataagggggagcgtatgcaatgaaagtgctgataataagtgacagtcacggccttgaagacgagctggagacgattgcaaagcggcacgaagacgaagcggatctgatgattcattgcggtgattcagagcttgacgccgcacatccggcactcacgccgtatcacaaggtgaaaggcaattgcgactttggcggcgggtttcaggatgaactccttctggatgccggttcaaagaaaattctggccgttcacgggcatcttcacggcattaaacagtcacttttaactgttttttaccgggcggaagagcttggggcggatatcgtctgcttcggccattcacatattgcggggagtgaagtgcttcggggcaagcttttgattaatccgggcagcatccgtcttccgagagtccgcaatgtgaaaagctatgccattcttactcttacagaaagagaaggcgccgtgatattttacgacgaaacgggtcgggaattgaaggacttggggaatacaatcagtttttaacaagtgatgggggagatttcattcttccccatcaaaagtttttaaaaaaatattgacttatgatttgaacctgtatataataaatcttgtcgctgatacataaagcaaaagctgtcccagtagctcagctggatagagcaacggccttctaagccgtcggtcgggagttcgaatctctcctgggacgtacaaaaaaaagagctggtgacatcagagtgaaaactgatgccgctggcctttttatcggatgactatattgtcaattcactgatatcatggtaaaataatcagcagatatttgtttttcatgtcccagtagctcagccggatagagcaacggccttctaagccgtcggtcgggagttcgaatctctcctgggacgtataaaaaacctcaagccctgacaatgggtttgaggtttttttgtattttatttttagttttacgaaacaaaagttccgtatttgatgaaaattgtaaagtaattttaatgtaaatgaaacttaatgtaatatttaccgtaataaatatatgtataaagatacttaaggcgcccttgagtgataaattatctgatttctatcatacgttttgttgatgattgatagaaagacagcaggaggaattagcttttgaagtacgcatttgcatataaaaatcacaatatagaaacgatcttttgcggaaaagacgagctgtttgaggaactgaaacaatttttaatcactcaatgcggtttaatcattgttgaggtttcaagggctgattactatacggagcaggaaatgaatcagtggaatgaccgttatactctgtgaataagaaaagaaaccggccgtgtgagaccggtttttgtatcatctgaatccgctcggagcgctgaagcccccggcatggccgctgaaaccgcccccgagcgcgccgggatgtgccccggcgccgaggcttccgccgacgtcactgaaggtttggccgtagtacccggatgtataagggtacggaacgaattgctgtccggcgaatgacagtgtgctttgcggggtctgctgtccgtatccggatggcggaaatccctgctgaaaagaagggccgccttgatatggtgctgtatgcatcggggccggaggatagtaagactgcggcggtaagaccggtaaaggcggaaatccaggaggcaggccctgcatgcctgataacatcttattcatgacatcactcatttcttacgagataagaacagtgtatgcgtatgtctgtataaagagcctgttcaatcgaacggaatatctgacaagcatgccggaaggacagagaaaaatcgcgtaataaaatgtgacatattcgtatatgaacggaaaaatttcatgtaatcttgagagattaataaaaaaaatataaaaacttttaacatttgccgatccttttatatcagtaatgaaagcgtatacaaaatagattgattaatctaaattgtctaataattataaaaatgctgttgacactgtctgcaaacgggcgtaatatgagttcaaacaaaaataaataaatgattcacgctaaaaagaaaaatcataaaacactgaaaaaacaaacaaatgaaggttcttttttaataaaagagctgccataataaaaagcgcagaagaggataagtagctttgctgaagtttttcacagagagccggtaacgctgagagccggtaaaacaaatcaaagtgaactcccctcagagtgccggtctgaaatgtaaagagtaggactcggccgagtgaacgcaatgtttactcgttatcaaaacggataatcattatccatgagacggtctgcatatgaccgtaaacaagggtggtaccgcggagagcaaagccttttcgccccttttggctatcgcatgaaatgcttggctgaatgtgggtgggaaggcttttttatttgcgtcagccggcgctgcgttttatgaattggattttagaagggaacattgaaaaggaggaactgaaaatgggcacaaatgtacaggcggattctttgtctgccgattgtacaaaaacaatgaacggggctctgatgctgattgaatcattaaagaaagaaaatgtcgagatgatcttcggctatccggggggagccgtccttccgatttacgataaactgtatcaatcaggattggttcacatcctgccccgccacgagcaaggcgcgattcatgcggcagaagggtatgcgagagtctccggaaagccgggggttgtgattgctacctccggacctggagcgacaaatttagttaccggtcttgcggatgcgatgattgattcactgccgctcgtagtgtttaccggtcaggtggccacttcggtcatcggcagcgacgctttccaggaagccgacattttaggaattacgatgccgattacgaaacacagctaccaagtccgccgtccggaagatctcccccgtgtgattaaagaggcttttcatatcgccgcgacgggaagaccgggcccggtattaattgatataccgaaggatgtcgcagcatttgaaggagaattcagatatgatcacgagatcagccttccgggttatcagccggtaaaagagcctaactatctgcagatccgaaagctcgtggaagctgtcagcagtgcgaaaaagccggttattttagccggagcgggtgttttgcacggtaaagcttcagaagatttaaaaaattatgccgaacagcagcaaattccggtagcgcacacgcttctcggtctgggcggtttcccggcagaccatcctctttttctgggaatggcggggatgcacggcacatacacagcgaatatggcgctttaccactgtgacttgttgatcagcatcggagcgcggttcgatgatcgcgtgaccggaaatctgaagcattttgcaaaatcggccaaagtagcgcatatcgatattgatcctgctgaaatcggaaaaattatcgaaacgcagattccggtggtcggcgacagtaaaatcgtccttaaggaattattgaagcaaaacggaaaacagggacagacagaggaatggaaacagcagctttcagaatggaaagaagaatatccgctttggtatacagacgacagagaagagggcttgaaaccccaaaagctgattgagtatattcaccaattcacaaacggtgaggcgattgtggcgacggatgtcggccagcaccagatgtgggcggctcagttttatcctttccgaaaggctgataagtgggtgacctcgggggggctcggcacaatgggcttcggccttccggcggccatcggagcgcagctggccgatcgtaacgccacggtcgttgccatcctcggagacggcggttttcagatgacccttcaggaattagatgtcatccggcagctgaaccttcctgtcaaagtggttatcttgaacaacgaatgtctgggcatggtcagacagtggcaggaaatcttctatgaagaacgctattctgaatccaaattctcggcgcagcctgactttgtcaaattgtcagaagcctacggcattaaaggcgtccggatttcatcggaagaagaggcggaagaagagcttaaaaaggcgctttcatcaaaagaaccggccgttattgacgtccgggtcgccaaaagcgagaaagtattcccgatgattgcgccgggtaaaggacttcatgaaatggtgggggtgaaaccttgaaacgcattatcacattaacggtggtcaaccgctcgggggtattaaaccggatcaccggcctgtttacaaaaagacactataatatcgaaagcatcactgtaggccacacggaaacaagcggtgtttcaaggattacatttgtcgtccatgtggaaggcgaaaatgacgtagagcagctgacaaagcagcttaacaaacaaattgacgtcctgaaagtgacggatattacaaaccaatcgattgtacagcgtgagctggcattaatcaaagttgtttccgcaccgtcggccagaacggaaatcaatggaatcattgagccgttcagagcttccgtcgttgatgtctcaagagacagcatcgtcgttcaggttaccggtgaatctaataaaatcgaagcgctcatagagcttctcaaaccttacggaattaaagaaatcgcgagaacgggcacaacggcttttgcgaggggaacccagcagaaggcgtcatccaataaaacaatttcaattgtataacacaaaaaagggagagattaaaatggtaaaagtatattataacggtgatatcaaagagaacgtattggcaggtaaaaaagtagcgattatcggttacggttcacaaggtcatgcacacgcgctgaacttaaaagaaagcggaattgatgtcattgtcggcgtcagacaaggcaaatcatttacacaggcccaagaagacggtcataaagtcttttcggtaagagaagcggctgcccaggctgatatcattatggttcttcttccggatgagcagcagcaaaaagtatatgaagctgaaatcaaagatgaattgacggcgggcaagtcattggtattcgcacacggatttaacgtccatttccatcagatcgtgcctcctgctgatgtggatgtattccttgtcgcccctaaaggacctggacaccttgtcagaagaacatatgaacaaggcgcgggcgtaccggcattgtttgccatctaccaggatgtatcaggcgaagcgaaagatacggctcttgcttatgcaaaaggaatcggcggagcgcgtgcgggggttcttgaaacaacatttaaggaagaaacggaaacggatttgttcggtgagcaggctgttctgtgcggaggtttaacggcgcttgtcaaagcgggttttgaaacgctgacagaagccggctaccagcctgaactcgcatacttcgagtgtctgcacgaactgaagctgatcgtagacttgatgtatgaagaaggattggcgggcatgagatactctatctccgatacggctcaatggggagactttgtatcaggaccgcgcgtagtcgatgcgaaggtaaaagaatcgatgaaacaagtattaacggatattcaaaacggtacattcgcaaaagaatggatcgtggaaaaccaagtgaaccgtcctcgtttcaatgcgatcaatgcaagcgaaaacgagcatcagattgaaaaggtcggcagacagcttcgtgaaatgatgccgtttgtcaaacaaggcaaaaagaaggaagcggtggtctccgttgcgcaaaattaatgttttcgacacgacccttcgtgacggtgaacaatctcccggggtcaacctcaattcccgggagaaactggcgatagccaagcagcttgaaagactcggggtggacattattgaagcgggatttcccgcttcatcccgaggtgattttttagccgtgcaggaaattgcaagaacgattaaaaattgttcggtaacagggcttgcccgatctgtcaaaggtgacattgacgcagcctgggaagcgctgaaagacggggtcagcccgcgcattcacatctttatcgccacctctgacattcatctgaagcataagctgaaaatgacgcgggaagaggttaaggaaaaagcggttgaaatggtgaagtatgcaaaagaacgctttccgatcgttcaatggtcggcagaagacgcatgccgcaccgaacttccgtttctggctgaaatcgtagaagaagtgattgatgccggcgcgagcgtcatcaacctgccggacactgtaggttacctgacgcctgctgaatacggaaacatctttaaatatatgaaggaacacgttccgaatatcagccgggtaaagctctcagcccattgccacgatgatctcggaatggcggttgccaactcactttcggcaattgagaacggcgctgatcaaattgaatgcgcccttaacggcataggagaaagagccgggaacgccgcgctagaggaaatcgccgttgcgcttcatgtcagaaatgacgcgcatcaagccgattcatctctcaatcttcatgaattgaagcggacgagtgatcttgtcagcaaactgacgggcatggccgttccccgcaacaaagcaatcgtcggagataacgctttcgcacatgaatccggcattcaccaagacggtttcctgaaagaaaaatcaacatatgaaatcatttcaccggaacttgtcggcgtgactgctgatgcgctcgtactcggaaagcattccggacgccatgcgttcaaagaccgcctgaatgcgcttggattccagtttgatagtgaggaaatcaataaattttttacgatgtttaaagaactgaccgaaaagaaaaaagaaatcaccgatgatgacttgatttctcttattttagaagaaaaagtgacggacaaaaaaatcggctatgaatttctgtctctgcaagtgcattacggaacgtctcaggtgccgactgcaacagtctctttgaaaaatcaggaaaacgaacagctgattcaagaggcggcaacgggggcgggcagcgtagaagccgtttataatacgctcgggcgctgcatcgataaaaatattgaactgacagactaccgcatccaatccaaccggaaaggcgaagacgcgctggctcaagtttatgtcagagtgaccgtgaacggaaaagaaacatcaggacggggaatcgcgcaggatgttctggaagcttctgcaaaagcttatctgaacgccgtgaaccggcagttggtgctggattgcaatatagacggattaaagagacggactgcggtcggctcgtaatagagaggagaacgtttgatttgaaaaaacgcattgctttgcttccaggtgacggaatcggaccggaagtggcggaatcagcggcagatgtattgaaaagagttgccgaacaattcggacatgaatttgaatttgaaaacgggctgatcgggggagcggcgattgacgcccatcaaaacccccttcctgaggagacggtggctctttgtgaaagatccgacgccatcctgctcggggcagtcggcggaccgaaatgggaccaaaatcctccggagctcagaccggaaaaaggcctgctcggcatcagaaaaaagctcggcttgtttgccaatctgcgtcccgtgaccgtatttgaaagcttgtctgaggcgtctccgctgaaaaaagaatatatcagcggcgtcgactttgtaatcgtcagggaactgacgggcggcctctacttcggagaaccgagcagacagtatgtcaatgaagcgggagaaaaggaagcggtcgatacccttttttataagaaagaagaaatcgcacgcgttgtcagagaagcctttaagatggctgctggcagaaaaggaaaagtgacgtccgttgataaggcgaatgtgctttcttcaagcagactgtggcgtgaaacggcggatgaaatcgcaaaagaatttcctgatgtgacgcttgaacatatgcttgtcgataatgccgcgatgcagctcatctacgctccgagccagtttgacgtcatcgtaactgagaatatgttcggcgatattttaagcgatgaagcctccatgctgacaggctcgctcggcatgctgccgtcagccagtttatcaagttcaggtcttcacttgtttgaacccgtgcatggatctgcgcctgacatcgccggtaaagggatggccaatccgtttgcggcgattttatcagcggcgatgcttttgagaacatctttcggacttgaaaacgaagcgcaggcggtggaaaaagcggtcgcaaaggtgcttgcagacggcagccgtacacgtgatatcgcccgggacggccaatatgccggaacgcatgacattactgaaaaagtaaaagccgcattagccggctcgaatacaaaatctatagtgtgacgctttaaagaaagcggtcttagttcataggtagagggaggaaacaaagatgatgcctcgaacaatcatcgaaaagatttgggatcggcatgttgtaaaaagcggtgaaggaaaacccgaccttctctatattgatctgcacctcattcatgaggtgacgtctcctcaggcgtttgaagggttaaggcagaagggaagaaaggtcagacggccgcagaacacattcgcgacgatggaccacaatattccgaccgtcaaccgttttgacattaaagatgaagtcgcaaagcgccaagtaaccgcgcttgaacggaattgcgaggagttcggcgtccgtcttgcggatcttcacagcgcagaccagggaatcgttcacgtggtcgggcctgagcttggtctgacacttccgggaaaaacgatcgtttgcggagacagccatacatcgactcacggcgcgttcggagcgcttgccttcggtatcggcacaagtgaggtggaacatgttctttccacacagacattatggcagcagcggccgaaaacgcttgaaatccgcgttgacggaacgctccaaaaaggagtgacagcgaaggatgtcatcttgtcggtcatcggaaaatacggggtaaaattcggtaccggatatgtcattgaatacaccggggaagtattcagaaacatgtctatggacgaacgcatgactgtctgcaatatgtcaatagaagcgggagcccgtgcgggactgatcgctcctgatgacacgacgattgaatactgtaaaaaccgtaaatacgcgccaaaaggcgaggaatttgaaaaagccgccgcagaatggaaagcgttaaaaaccgatccgggcgccgtatacgatcattccatcgtgttagacggcagcgagatttctccaatggtaacatggggtgtcaatcccggcatggttcttccggtcgatgcccaaatacctgcgccggaaacgattgattctgaagacggtaaaaaagaagccatccgcgcttacgaatacatggggatcgcgccgaatcaaaaaattgaagatattaaagtagagcatgtgtttatcggctcctgtacaaattcacggatgaccgatcttcgccaggctgcggatatgatcaaaggccgaaaagtcgccgacagcgtcagagccattgtggtgccgggttctcaaagcgtgaaacagcaggccgaggaagaagggctgcaccgcgtgtttctcgaggccggctttgaatggagggaatcaggctgcagcatgtgcctcagtatgaacaatgatgtcgtgcctgaaggggaacgatgcgcttccacttccaaccgcaacttcgaaggcagacagggaaaaggcgcgagaacacaccttgtcagtccggcgatggcggcaatggcggccattcacgggcatttcgtcgatgtaagaaagttttatcaagaaaaaacagttgtgtaaggagtgcgcgaaaagatggaacctttaaaaacgcatacgggaaaagcggccgtcttaaaccggatcaacgtcgatacggaccagattattccgaaacagtttttgaaaagaattgaaagaaccggatacggcagattcgcgttttttgattggagataccttgagaacggtgagcctgatcctgaatttgaattaaaccgcaaagtctatgaaggcgcgtccatattaattgccggagagaatttcggctgcggatcatcccgtgagcacgctccttgggcgctggatgattacggcttcaaaatcatcattgctccgtcatttgccgatatttttcatcagaactgttttaaaaacggtatgcttcccatccgtatgccgtatgatcagtggaaaaaactcgccggtcaatatgaaaatcagtctctaaatatgacggttgatttggaaaaccagctcattcacgacagtgaaggaaaagagatttcatttgaagtcgatccgcactggaaggaaatgctgattaacggttatgatgaaatttcattaacgcttctgctggaggacgacattcagcagtttgaatcgaaaagaagttcatggcttcaagcctgaaaaaagccgcccggcatctgtccggcggctttttttaccgtgtgcatcatcctttcttgtgtttcatgacgcgtgttgatacacttgaacaaaataagcgcctgaaaggaaataaagtatgacgcatgacaagaaaaaagctgatatcattcctttcccccgtctgaaagaacgcttggttgataaagggatggccgccatgaaggataaacagtatgaggaggccctcgaactgttttcagaggcggtaagccacggcgataccgagtccgacgtacatttaggcatggcgatttgttttctggaactcggggaattggaagaagcaaaacaagtttgcgagaaaatgctgaatgaagggtacggccattatttcaccgtattgcaggtgtacatgaccattttaattcagctgaaacaatatgaagaagtcaaaagcacaattgaagctgtgctggaagaaaaccagctgcccgcagaaagtgcggagcaattctaccggctgctcgaattcagccgcaaaatgaccgatcccgatcagcaggaggaggcgtgggaggaggaatacgaggacattcttgatacggaaaaagtgctgaacagccccgctgaacaaatgaatctgattcattctcttaaagaccgcaatattgcaaaatacacgggtctcttaaaaacgattcttcaagatccgggcgcgcatcctcttattaagacaatgattttgacgctgatggccgagcacgactacagtaaaccggtccatattacaaaattcggcgattcaatgaccgcgataccgagtgaaacggtccagcctgatgcggctccgattttgcatcgcgttctccgggtgcttgatgaaacgctgggcaatgaaaaccctacattatatgctgccgtcgaggagctgtggagaagacatctgtacgtcctgcacccttttatgccgaagtttttgaacgcggatttatgggcggcggcgcttcataaggtcggttacgagatgcacggcattgacattgagccggaggaacttcatatgatgtacgagtttgacagccgcgaactcgaagaagcctgcacgatgattaaggatattgaagaaatttcttatttgtaaatcacaccatatagttgaaagcagtaggcgttatgttataatatagtggttgtatttatgtatagcggtttaactgaaatgagaattacggttggacaggctgccagttcattacataatgattctgattcaaagcggttttttctttgacaaagccgcggattgctttagaatggaagaccgacacaacctgaatagatttttggagggaaacacatgtctgtaaaatgggaaaaacaagaaggcaacgaaggcgtattaacggttgaagttgatgcggatacgttcaaaacagctcttgatgatgcatttaaaaaagtagtaaaacaggtttctattcctggattccgcaaagggaaagttccccgcggtttattcgaacagcgtttcggcgttgaagctctttaccaggatgctttagatattttacttcctgtagaataccctaaagcggttgaagaagccggcattgagcctgtagaccgccctgaaatcgatgttgaaaaaatcgaaaaaggcgaaagcttaattttcactgcaaaagtgactgtaaaaccggaagtgaaacttggcgattacaaaggcttaggaatcgaaaaagatgacactgccattactgacgaagatgtacaaaacgaacttaaagcgcttcaagagcgtcaggctgagcttgtcgtgaaagaagaaggcgctgttgaaaacggcgatacagtcgttcttgacttcgaaggtttcgttgacggcgaagcgtttgaaggcggaaaagctgagaactattcacttgaagtaggatcaggttcattcatcccgggcttcgaagagcagttaacaggccttgaagcaggcgctgaaaaggatgttgaagtaacattccctgaagagtaccacgctgaagagcttgccggaaaaccagctgttttcaaagtgaaaattcatgaaatcaaagcgaaagagcttcctgagcttaacgacgaattcgcaaaagacattgacgaagaagttgaaacgcttgctgaattaactgagaaaacaaaaaaacgccttgaagaagcaaaagaaaacgaagctgacgctaaattgcgtgaagagcttgttctgaaagcatctgaaaacgctgaagctgatgttcctcaagcgatgatcgacactgagcttgaccgcatgctgaaagaattcgaacagcgtctgcaaatgcaaggcatgaaccttgagctttacactcaattctcaggccaagacgaaaacgcgttaaaagagcaaatgaaagaagatgccgcaaaacgcgtaaaatcaaacctgactcttgaagcgatcgctcaagcagaaaaccttgaagtaacggacgaagaagttgaagctgagctgactaaaatggctgaagcttacaacatgccggttgaaaacatcaagcaggcaatcggttcaactgacgcgatgaaagaagatttaaaagttcgaaaagcaattgattttcttgtagaaaaccgttaatatggttcataataatagacataataaaacagggcgcgattaattcgtgccttgttttgtacaattatgatataactctttttcttggggcaagatagtcattgccgggctgtttttcgtcatacatatagaatgtgcaagtgcgaaacacattgttaccgtcttactggaaagtatggtaaaatgcaatacatactcgatcgtagcaagaaccgttttcttttgcccttcaggtaaaagaaaaagtgagacaagattaaggggtgaaagaatgtttaaattcaacgaggaaaaaggacaattgaaatgctcgttctgcggaaaaacgcaagatcaggttcgtaagctggttgcaggaccgggtgtatatatatgcgacgaatgtattgagctctgtacagaaatcgtagaggaagagcttggtacggaagaagaagtcgaatttaaagacgttccgaagccgcaggaaatccgtgagattctgaatgaatatgtcatcggacaggatcaggcgaagaaatcacttgcggttgcggtatacaaccattacaaacgcatcaattccaacagtaaagtggatgatgttgagctttctaaaagtaatatttctttaatcggaccgactggaagcgggaaaacacttcttgcccagacgcttgcgcgtattctgaacgttccgtttgcgatcgcggacgctacatctctgactgaagccggatatgtcggtgaggacgtagaaaacatcctcctcaagctgattcaggcagcagactatgatgtggaaaaagcagaaaaaggcattatctatatcgatgaaatcgataaagtagcgcgaaaatctgaaaacccgtccattacacgcgatgtatcaggcgaaggcgttcagcaggcgctgctgaaaattcttgaaggaacggttgcaagcgtgccgcctcaaggaggacgcaaacatcctcatcaggaattcatccagatcgatacgacgaacattctgttcatttgcggcggtgcatttgacggcatcgaacaaatcatcaaacgccgtctcggacaaaaagtcattggcttcggctctgataataaagcggcagacctggaaaaagaagaactgctttctaaagttcttccggaagacctgctccgtttcggtctgattcctgaattcatcggccgtcttcctgtcattgcaagccttgagcagcttgacgaaacggcactggttgaaattctgactaaaccgaaaaacgcactcgtcaaacaatacaagaaaatgttagaacttgatgatgtcgagcttgaatttgaaggcgaggcattatctgaaattgcgaaaaaagcgatcgagcgtaaaacaggcgcacgcggcctgcgttctatcattgaaggcatcatgcttgacgtcatgtttgatctgccgtcccgcgatgatattgaaaaatgtgtcattaccggagcgacagtcgcagacggtgaagcgccgcgtcttgtattaaaagacggcactgttgtcggccaagataaaacatcagcataacacgacaaaacctcctgacccgaattaatcaggaggttttttttcttgtcctgacccttctgaaaatgtttattccgggctttgctgggagatactagcggacagaggaatgaattggatacataaatcgttttttcaggagggaccagcatgagttggacagggatcgcattatttgtacagctgtttttcgggatagtcatcggactatatttttggaatctgctcaaaaaccagcgaacacaaaaagtgacgatagataaagaatcaaaaaaggaaatggaacagctgcgcaaaatgcgcgccatcagtttatcagaacctttatcagaaaaggtgcggccgaaaagctttcaggacattgtcggccaggaagacggaattaaagcgttaaaagcagcgctttgcggaccgaacccgcagcacgtcattatttacggtcctccgggagtcggtaaaacggctgcggcgcggctggtattggaagaagcgaaaaaacataaacagtcaccgtttcaaaagcaggctgtttttgttgaacttgatgcgacgaccgcgcgatttgatgaacgggggattgccgatccgcttatcggttcagtgcatgatccgatttatcagggagcgggtgcgatgggccaagcaggcattccgcagccgaaacagggggctgtgacccatgctcacggcggggtattgtttattgatgaaatcggcgagcttcacccgattcagatgaataaaatgctgaaggtgcttgaagaccgaaaagtatttttagacagtgcgtattacagtgaagaaaatacgcaaataccgaatcatatccatgatatttttcaaaatgggcttccggcggatttccgtttgatcggtgcgacaacgagaatgccgactgaaattcctccggccatccgttcgcgctgtcttgaagtatttttccgcgagctggaaaaggatgaacttaaaatcgttgcgaaaaaagcagccgacaaaattcagaaagagatttctgacgaagctctcagcgtgctgaccgcatatacgagaaacggacgtgaagccgtcaatatgatccagatcgctgccggcatggcggtgactgaggacagaaaagaaatcacgacagaagatatagaatgggttgttcattccagtcagcttacacctaaaaatgagcagaaaatcgccgatgaaccgcaagtcggcatcgtgaacggacttgccgtctacgggccgaacagcggcgcattgctggaaatcgaagtgaatgtcacacctgcgcaggacaaaggaagcctgaatatcacgggaattgcagaggaagaaagcatcggcagccaatcgaagtcgatccgccgcaaaagcatggcgaagggatctgtggaaaatgtgctgacggttctccgcacaatgggcatcaaaccttcagactatgacattcacgtcaattttccgggcggaggcccgattgacggaccttcagcaggtatcgcgatggccgcggggattttttccgcgattcaccgcatcccgatcgaccatacggtggcgatgacgggagaaatcagcctgacggggcttgtcaaaccgatcggcggcgtcattccgaaaattaaagccgcaaaacaggccggagcaaaaacggtcattatcccatatgaaaatcagcagtccattctgaaacgaatagacggaatcaccattaaagcggtaaaaacgttccaggaagtgcttgacgtcatattggttgaccctccttcagaacaaaaaccgtttgatatccaaatgaataaagaatccgtataaaccccatttttataatggggtttttttatggaggacatcttttcctttttcagaacagaaagaaagggtatactacgaagagactgttttatatacagggcaggcggataagccgattaaagcccgatcccggaattgtacaacgatgaaaaagttgtattataatggttcatactaaagtcacggaggtgtcagtcacatggcagaagatacaaaacgcagcatcccgctcctccctttaagaggcttattggtatacccgacaatggttttacatttagatgtaggccgtgacaagtcggttcaggctcttgaacaggcaatgatgcatgatcatatgatttttttagccactcagcaggatatttcgatagacgaaccgggtgaagaggatattttcgccgtcggcacttatacaaaaattaaacagatgctgaagctgcccaacggtacgatcagagtgcttgtagaaggaattcagcgggcgcagatccttgaatacaccgaactcgaagattatacttcggtcgatatacagctgatgcatgaggatgattcaaaagacgtggaagacgaagcgcttatgcggacgctgctggaccattttgaccagtacataaaaatttctaaaaaaatttccgcagaaacgtatgcggctgtgactgatattgaagagcccggcagaatggcggatatcgtcgcttctcatctcccgctgaaattaaaggacaagcaggacattttagaaacggcggatattaaagaacgtctgaataaggtcattcgttccattcataatgaaaaagaagtgctggagattgagaaaaaaatcggtcagcgcgtcaaacgttcgatggaacgcactcaaaaggaatattatttgcgcgaacagatgaaagccattcagaaggagcttggcgacaaagaaggaaaaaccggcgaagttcagtcgctcacggaaaagatagaagaagcaggcatgcctgagcgtgtcaaagaaacggcgcttaaggaattaagccgttacgaaaaagtgccgtcaagctcagcggaaagctctgttatccgcaactatatcgactggcttatcgcccttccgtggtcggatgaaacagaagataaacttgatattaaaaaagccggggaaatcttagataaagagcatcacggcttagagaaagtgaaagagcggattttggagtatttggccgtgaaacagctgacgaaaacgctgaaagggccgattctttgtctggccggacctccgggagtcggtaaaacatctcttgcaaaatcaatcagtaagagcatggggcgcacttttgtgagaatttcactgggcggagtgcgcgatgagtctgaaatccgcgggcaccggcgcacatacgtcggggcgatgcccggccgtattatacaggggatgaaaaaagccggcaaacaaaatccggtctttctcctcgacgagatcgacaaaatgtcgtctgatttcagaggcgatccgtcttcggcgatgcttgaggtgctggatccggaacaaaacagcacattcagcgaccactatattgaagagacgttcgatttatcgaaagtactgtttatcgcgactgcgaataaccttgcttccatccctggccctctcagagacagaatggagattatcagcctgtcaggctacactgaaaacgaaaagctggagatcgtgaaagatcacctgctgccgaaacaaatcaaagagcacgggctcacaaagagcaacctgcagattcgggatcaggcgattacggacatcatccgctactacacgagggaagccggcgtgagaacgcttgaacgccagattgccgccatttgccgaaaggctgcgaaagccattgtgtctgaggagagaaaacgcattaccgttacagagaaaaatctggccgactatctcggaaaacggatattcagatacggacaggcggaaaccgaagatcaaatcggggttgtcacggggctcgcgtatacgacggtcggcggagatacgctgtcaatcgaagtgtcattgtcaccgggaaaaggaaagctggttctgacagggaagcttggagatgtcatgcgggaatcagcgcaggccgctttcagttatgtccgttcgaaagcggaacagttcggaatcgacccgaaattccatgagaagtatgacattcatatccatgtccctgaaggagcggtgccgaaagacggcccttctgccggaattacgatggccacggcgctcgtttcagcattaacggaccgtgcggtaaaacgcgaagtcggtatgacgggagaaatcacgctgcgggggcgcgtgcttccgatcggcggactgaaagaaaaggcgctcggcgcgcacagagcgggcctgaccactattattgcgcctaaagataacgaaaaagatatagaggatattccagaaagcgtcagagaaggactgaagtttatattcgtttctcacctggatgacgttttggaacatgccttagtaggagagaagaaatgaaagtcacaaagtcagaaatcgtgatcagcgcggtcaaacccgaacagtaccctgatggggggcttccggaaatcgcgctggcgggcagatcaaatgtaggaaagtcatcttttatcaattcattaatcaatcggaaaaacttggccagaacgtcatcaaaaccggggaaaacacagactttaaacttttacatcatcaatgatgaattgcattttgtcgacgttcccgggtacggatttgcgaaggtttccaaaagcgagcgggaagcatgggggagaatgattgaaacctatatgacgacccgtgaagagctgaaagcctgcgtgcagattgtcgacctcagacacgcgccgtctgctgaagacgtgaacatgtatgaattcctgaagtattacggcattcccgtcatcgtcattgcgacaaaagcggataagattccaaaaggaaaatgggacaagcacttaaaggttgtcaaacagacgcttgatatggatcctgaagatgagctgattttattttcctctgaaacgaaaaaaggcaaagatgaagcatggggagccattaaaaaaatgatcagccggtaatgaaaaacccaaaacgcagtgcgttttgggttttatcgtatagttttgttccgcttgataaacaataataaaaggctgattccgatgaaaacatacggccagtatgttttgaagtgttccgtcggaatatggacggactccagccacgccgtaatttgtttaaagaagtataaaaagagggaaaaaccaatcatggcagccgcttcgtatacatattcttttctggcagccgcaaataaggagaatccgaagacgaagagaatcatttcaaaatctcccggccaccatgagagctcaggtttggcgaaaaagtgtaaacctatgccgaaaagaagcatgccgatcaggacgtgaggcccggccgcttcctttttgccctgatacaagagcacggcccccaagagcataaggagcaccggccattccccctgattcgcaaacaggtgaacctgtccgctctgaagccatgcgaataatgaagcggcaagcagaagtcccggtaataaaattgatgtttttttcatcctgtcacctacccgcagtaaaggatttttagtatgatgattacagtggaaacgagctttttatactatagcataacatttttgaaatctgttcacattttcccgaagaaactatgttataattattataaataataaattctatgttagaatgattataaataaattgcgatgtacgggggtgcatgaaagcgatgcatattcttgttgtgggagtagattataaatccgcccctattgaaatacgcgaaaaaataagttttcagccggatgagcttgcagaagcgatgctccgcttaaaagaagaaaaaagcgttctagaaaacattatcgtgtcaacctgcaaccgcaccgaaatatatgcggtggtcgaccagcttcataccggccgttattatataaagacatttttatccgaatggttctcgctgccgaaagaagagctgtctccgtttctgaaattttatgagagcgacgcggcgatcgagcatttattccgtgtggcgtgcggtttggattccatggtcatcggagagacgcaaatactcggccaggtccgctcgagctttaaaacggcgcaggcagaaaagacgatcggcaccattttcaatgagctgtttaaacaggcggtgaccgtcggcaaacgcacgcatgccgaaaccgatatcggctccaatgccgtttccgtcagttacgccgccgttgaactcgcgaaaaaaatcttcggctcattgtcaaataagcacattttgattctcggtgcgggaaaaatgggcgagctcgccgcagaaaacctgcacggtcagggtatcggcaaagtaacggtcatcaacagaacgtttttgaaggcaaaagcgcttgctgaccgtttctccggagaagcgcgcagcttaaaccagcttgaacatgcacttgctgaagctgatattttaatcagttcgacaggcgcgagtgatttcgtcgtgtctaaagaaatgatggagagagcgggcagacagcggaaaggccgtccgttatttatggtggatatcgctgtgccgagagacctcgatccggcgcttaacgatcttgaaggtgtttttctgtacgatattgatgaccttgaaggaatcgttgaagccaacttacaagaacgccgcgaaaccgctgaaaaagtcgagctgtttattgaagcggcaattgttgagtttaagcagtggcttaatacgctcggcgtcgtgccggtcatttcggcgctgcgtgaaaaggcgctgtccatccagtccgatacgatgcagagcattgagcgcaagctgcctcatctgacagtgagagagaaaaaacttctcagcaaacatacgaaaagcatcattaaccaaatgctgcgcgacccgattctgaaagcgaaagagcttgcggctgaagcggattcagatgaaaagctgaagctgtttatgcagattttcgatattgaggaagaggccggccgccagctggacaaaagcctggataaccgccagacggttcattcgtttcaaaaggcagaagcaaaaacgggcttacgtccgcttgtaagtgagtgagggctgtatgattgatacagcaatggcaagacttaatgaagcgacaattgttatttatgcagtaagcgtccttttttactttatagattttcttcaacacaaccggaaggctggaaaaatagccttctggttgctttctattgtctggactctgcaaactgtctatctttcttatttcatgtggcagacgggcagatttccggtcttgaatattacagaggccctttacttttatgcgtgggtgcttgtcacgctttcacttgtggtcacgcagattctgcgggttgattttatcgtgtttttcacgaatgtcatcggtttctcgatgattgcgatccatacgttttcaccgacggatcagcattcggccgccttttccggccagctggtctcagagcttttggtcattcatattacaatggcgattctgtcttacggcgctttttccctttcttttgtcttttcgcttctttatcagtttcaatattctttattaaagaagaaaaaatggggaaaatggctgttgagaattgaagatttgtcaaaacttgattatatggcttacgttttaaatgtcatcggggttccgatgctgctgttgagcctgatattaggcgtgatctgggcgtatgtgtcgctggaaacgctgtactggtttgactcaaaagtgctcggctcgtttattgtgctgcttttatacagctactatttatatatcagaatgattaaggaactgcaggggaaagtggcggcgttatggaattcagcatgttttctcgtgctgatgattaattacttcctgctcggaagcctgtcacaattccattggttcagttaacgcgcgcgcccaaacagattcgggaggaaagaaaatgagaacgattaaggtaggttccagacggagcaaactggctatgacccagacaaaatgggtgattaacaaactgaaggaattgaatccttcctatgactttgaaatccgggagattgtcacaaaaggcgaccgcatcctcgatgttacactgtcaaaagtgggcggcaaaggtttgtttgtcaaagagattgaacaggcgctgctgcatcaggagattgatatggcggttcacagcatgaaagacatgcccgccgttttgcctgagggtcttgtcataggctgcataccgaaacgtgaggatccgcgtgatgcgctcatttcaaaagggcatcaaaagctggacggcataaaagaagggggcatcatcggcaccagcagtttaagaagaagcgcccagattcttgctgaacgccctgaccttacaattaagtggatcagaggcaatatcgatacgagacttcaaaagcttgaaacggaagattacgatgctattattttagcggctgcggggctttcgagaatgggctggaaagatgatgtcgtatcggaattcctcgaaccggaccgctgtctgcctgcggtcggccaaggcgctcttgccattgaatgcagagagtcggatgaagagcttttgaagctgtttgcgcaatttaccgatgagtatacgcagcgcacggtggcagccgaacgggctttcttacacgcgatggaaggcggctgccaagtgccgatagccgggtatgcgtccgtcaatgaccgggatgaggttgaattggtcggtcttgtcgcgtctccggacggaaagacgatttataaagaaacagcggcgggacatgatccggaagaaatcgggaaacgctgtgcggcgatgatgtctgaaaaaggagctaaagcactaatcgacagcgtgaaacaggagctcgaacaggatggcaaatgaccttcctttacaaggaaagaccgtgctcgtcacccggaacaaaagacaggcagcaccgttccgaaaaaaagtggaggcgctcggcggaacggctgtttccgcctctctgatcgcttttcaggaagcgctcccggatgaatgtgcggacagtctgcgggaagacctttctgaaccgggctggcttgtgtttacaagcgtaaacggtgtccggttctttttttcctaccttgatcagcatggccttgcgcttccggaacggaaaaaaattgcagccgtcggtgaaaagacagcgcgcgccctgaaagagcggggagcccggacggatgcgatgcctgacgagtatgtggcggaatgtctggctgatactttaaaacggcacgcatcagctgccgaacccgtttcattgataaagggcaatttatcacgcgatgtcataaaagcggagcttgagccgcttggctatcaaataagggaatgggtgttatacaataccattcaggatgaaaagggcatggacgagctgagacgggctgcatcccgctctcattttgattttattacgtttaccagttcatcggcggtgcatacgtttatgcacgcggtcggagacggagaaaaagcgtgggaaaacagcggtgcgagctatatcagcatcggccctttgacagagaaagcgctcttggaatacgggatctcatcccatgtgcctgacacctatacgattgaaggcatgctggacgtcatgtgcagcatgtcgggaaaggatagataatgatgaatcaaacatttaacagacaccgccgtttgcgcgcgaacgctgcgatgagagatctagtaaaagaaacacgtcttcacccttcagattttatttacccgttatttgtcgttgaaggactcgaaggaaaaaaagaagttccttccatgccgggggtttatcatgtatcactcgatttgttaaaggatgaaatggctgagctgatatcgctcggcattaagtcggtcatcgttttcggtgtgccggaagaaaaagacgcctgcggaacccaggcttttcacgatcatggcattgtgcagaaagggattgctgaaattaaaaagcattatcctgaaatgatcgtcatcgctgatacatgtctctgtgaatacacggatcacggccattgcggggtcgtgaaagacggagtaatcctcaatgacgagtcgcttgagctgctggcgcagacagccgtcagccaggctaaagccggcgctgacatcatcgctccttcaaatatgatggacggttttgtcacagtgatcagggaagcgctcgacaaagaaggattcacgaatattccgatcatgtcttatgccgtgaaatattcaagtgaattctacggcccgttccgcgacgcggctgacagcacgccgcagttcggtgaccgaaaaacataccagatggatccggccaaccgcctggaagcgctacgtgaggctgaatcagacgcggcagaaggcgctgactttttaatcgtcaaaccgtctatgtcatacttagatattatgcgtgatgtgaaaaaccgccatcacctgccgctggtcgcatataatgtgagcggggagtattccatggtgaaagcggcagcccaaaacggctggattaaagaaaaagaaatggtgctggaaattttaacgggcatgaaacgtgcaggagccgatctgattatgacgtatcatgcaaaagacgcagcgaaatggcttgctgagtaacgatttcatttgacgggagctgaggcagatgagaagctatgaaaaatcaaaagccgcttttaaagaagcgcagaaactgatgccgggcggagtgaacagcccggtgcgcgcgtttaaatcagttgatatggacccgatctttatgcagcgcggcaaaggatcgaaaatttttgatattgacggcaatgaatatatcgactatgtgctgagctgggggccgctcattttgggccacacgaacgacagggtcgttgaaagcctgaaaaaagtagccgagaacgggacaagtttcggggcatctactgaagtggaaaacgaactggccaaattggtcattgaccgtgtaccgtctgttgaaatcgtgcggatggtcagctccggcacagaggcgacaatgagcgccctgcgtctggcaagaggatacaccggccgcaacaaaattttgaaatttgaaggctgttaccacggccatggtgattcgctgctgatcaaagcgggatccggagtggcgacactcggcctgccggacagcccgggcgtgccggaaggaatagcaatgaatacgattaccgttccatacaacgacttggaaagcgttgcactcgcattccgggagtacggtgaagatattgccggggtcattgttgaaccggtagcaggcaatatgggcgttgttccgccgcaggaaggctttttacaaggacttcgcgacattacggaacagtatggcgcgctgctcatttttgatgaggtcatgaccggttttcgcgtggattataactgcgcgcaagggtatttcggcgtgacgcctgacttaacgtgtctcggcaaagtcatcggcggcggtcttcctgtcggtgcgtatggcggaaaagctgacattatggaacgaatcgcgccgagcggtccgatctaccaggcgggaacattgtctggaaatccgcttgccatgacagcgggacttgagacgttacagcagctcacacctgaatcataccaagaatttgtgaaaaaaggcgatatgcttgaagaaggcatttcaaaagcagctgcagcacacggcattccgcacacgtttaaccgggcggggtcaatgatcggcttctttttcaccaatgagcctgtcattaactatgaagcagccaaatcttctgatttaaagctgttcgccaagtattataaagggatggccgacgcaggcgtatttctgccgccgtctcaatttgaaggattgtttctctccactgcgcatacaatggaggatattgaaaataccattcaagccgctgagaaagtgttccaggcgatcagccgctgataccgaaaagccgatgcaagcaagacttgtatcggcttttttcaatgcctccattatcatattttcccggattgcggcatacacctttagtgacatctaattgtatggattagatgaaaggaggatatgaacttgccgcataatcaccgattgcaattttctgttgaagaatcaatctgtttccaaaaaggacaggaagtttctgaattactttcgatttcattagaccctgacatcagggtgcaggaagtaaatgattatgtctcaattaaaggatcattagaacttactggcgagtacaacatagatcacagcagtcattttgaagagcttgatagggagctgaggcatgtagaggaagtgagggcgagggaggatggcacggccgagctcattcattgtttcccggtggacatcacgattccgaaaaataaagtgagccacctcaatgatgttttcgtatttattgatgcctttgattatcagctgacggattcaaggatcttaaccattcaagctgatttggcaattgaagggctgcttgaggaatccgagccgaaagagccggagatccctttgtacgtggcgcctgaatttgccagagaagaaatgatcaatcttgccggacatcattctgaggacgaaaatgaaccagaattaatgatacgccatgagcctgaaatacctttgactgtatcagaagaagcagcacaagaaacagagaagaacgaggaagaaatcccgcctttactcaggcaggaggaagaagagcaggaaacagccccgattctgagggagcaggaagaagaggaggaaacagccccgattctgagggagcaggaagaagaggaggaaacagccccgattctgagagagcaggaagaagagcaggaagcagccccgattctgagggagcaggaagaagagcaggaagcagccccgattctgagagagcaggaagaagagcaggaagcagctccgattctgagggagcgggaagaagagcaggaagcagccccgattctgagggagcaggaagaagagcaggaagcagccccgcttctgagggagcaagaagaagaagagcaggaagcagccccgattttgagggagcgggaagaagaagagcaggaagcagccccggttttgagggagcaagaagaagaagagcaggaagcagccccgattctgagggagcaagaagaggtgcctaaacctgtttcctttactgagcctcctcctcccgtttccttccagcacgaagaagagccggaagaagctgaggagcctgcaatcatgtcagctgtgaggaatgaacccgtatttgaggatgattcagcagaagtgcaggaagagccgaaagatgatatcgaaccggttttccctgctttcactctgactccgcatgcagaaaaaccaaaaattgcggaacagctcttccttcaaaaagaagagcagccagaggccgagccgcttctccgtcagagcgatcataaggcggcagaagacgaagatgagcctgcggtttttcaagaggagcaggcgcccgtttatcgcgagttcgttccggaacggcaggaagaagagttttacagcgctcctaagctgcttgaagaagaggctcatgatgaagaagggtttgaaattgaggtaaggaagatggcgccgccggaggaggaaacagggaagcctctcgatttgtcttttcagttttccaaactgccgcctgaggagccggcgcaagctgaacagcctgagccgcttaagcctgaaagaaagaatgaagaagcggcaccgggaaccgagcagaaggaaaatgacaactctcattacttgacaaaattatttacaagggaagaagaaaagttttcaagaatgaaaatttgtatcgtgcagcagcaagatacaatcgaccgggtgtgtgaacgatatgacattacatcccagcagctcatccgaacgaatgctttatcgtttgatgacgagcttgaggaaggtcagcttctgtatatacctgaatataataacagccatgtgtaagcacaaagaggccgtaaaaatgtggtgaatggaatggaagcagtccaatcagtgcttcaggaatacgggctggcggctgagtatattgagcctgtcagcccgcatgtttggaaggtctactcaaactacggcatttttgctttgaaacagctcaagccggcccgcagcagtgaatttacggatcttatgattgagattgaggagaaaggctaccgatcatttgtgccgatctgccgcacgtatgccggcgatttttttgcggggagacagacggagaattcttattatttaatgccttggcttcagtacgatcaggaggaagaacgggatcaaaaacatgtttacctttttaaagaggtcgcgaagctccattctgcgactgtgcgggacatccaaatccggactgaagatatcagcggcttttatgaagcaacgaaaagagattgggaaaatgataagcttgtctatgaacaattcgccgaccgggcggaaaaagagtggtacctttcaccttttgaactgcaggccgttacgtatcttacagaaacggtttccgccgtcaattttgctctggaacgtctggaagaatggtttgacgcggcaaaggatcatgacaagacgagagcggtgatcaaccacggcagtttatcgagccgccactttctgtataatgatgcgggatcgggctttttcacgaatttcgagaaagctgcgctgggccctccgcaaaatgacctgctcggcttttactccagaatgttcagaagctatccgaaagcatgtccggaatgtctggactggttttatacgtatcacaaatcattcccgctccgtgaagcggaaatcagtctgtttctcagctatatggcttatccgtccgccatgtacaaagtgctgaaacggtatcagaccggccaaaggggctctgaaaaagaagagtgcacgcaattattaagagcgttttggcagatgaaaaacgttgagccttttctcatgaaggttcatcagattgagcgggagaaaaaaataaaagcggaaaacgagtcctcttcataacgggactcgtttttttatatccattccaaatgcagggcgcacgctaaaaacagcaggatggcaagcagcaggacatcaaaagtcgtcggaaagaaaatcgtcctgatcccctgaaagatcgtaatcggaataatgacttgcacggatacaaggcggacctgtctggcccactgggggagcgaataagaattgaatttttttctcacgggcaattcctcctcacattcgcctttctatgtatcgtatgtaaggggaagagcggggtgcatgcccatttatgtatgacggcagcggtttttggaaaagatgattgacgaatcaaaaacacttttactataataaagaacataataaataagatcatgagctgatataaatacacctgctttgaacgggaagagtacaagaaagacgcatgaagagagagaagctactgtgctgaaaggcttcttatgccgtctcattggaaggtcgcccgggagcataatttcttgaacatacagtagagaaattcgggccgcacccgttatccgtttaagtgcatgaacaaatctgttcatgaaaaaaggtggtaccgcgaaagagcttttcgtcctttatcaggatgaaggctcttttttagttgctcagccatttctaaacatgctggagggttatcatggatacaaacgaacaaacaatgccgacaaaatatgatccgtctgcgattgaaaaaggccgctatgatttttggctgaaaggaaaatactttgaagcgggcggcgatcaaacgaaacagccgtattctgtcgtcattccgccgccgaacgtgacgggcaggctgcacctcggacatgcgtgggatacgacgctgcaagatatcgttacgcgtatgaaacgcatgcagggctatgacgtgctctggcttccgggcatggaccacgccggcatcgccactcaggcaaaagtcgaagcgaaactccgcgaacagggcacaagccgttatgacctcggccgtgaaaagtttttagaagaaacgtggaagtggaaagaagagtatgctgatttcatccgcagccaatgggccaagatgggactcggactcgattattcacgtgaacgttttactcttgatgaagggctgaacaaagccgtgcgtgaagtcttcgtcaagttgtacgagaaaggcttgatttacagaggcgaatatatcatcaactgggaccctgccacaaaaacggctttatccgatattgaagtgatttataaagacgtacagggcgcgttttatcatttgcgctacccgttagcagacggttcaggctcaattgaaatcgcgaccacccgtccggaaacgatgcttggcgacacggctgtcgcggttcatcctgaagatgagcgctacaagcacttaatcggcaaaacggtgattctgccgattacaaaccgcgaaattccgattgtcggcgatgattatgttgatatggaattcgggtcaggcgccgttaaaatcacgcctgcccatgacccgaatgactttgaactcggaaaccgccacaatttagagcggattctcgtcatgaatgaagacggaacaatgaatgaaaaagcgctgcaatataacggcatggatcggtttgaatgccgcaaaaaactcgtcaaagatcttcaggaatccggcgttctctttaaaatcgaagaccatatgcattctgtcggccacagtgagagaagcggcgccgttgttgagccgtacctgtccacacaatggtttgtcaaaatgcagccgctggccgatgctgcggttgaccttcaggcaaaagaagagaaggttcacttcgttcctgaccgtttcgagaaaacgtacctgcactggatggaaaacatccgtgattggtgtatttcccgtcagctgtggtggggccaccgcatcccggcttggtatcataaagaaacaaaagaagtgtacgtcggccttgaggcgcctgaggacagcgaaaattgggagcaggattcagacgtgcttgatacatggttcagctccgcgctttggccgttttctacaatgggctggcctgatgaaaacgctgaagactttaagcggtattactcaactgatgtacttgtaacgggatatgacatcattttcttctgggtatccaggatgattttccaaggtcttgagtttaccggcgagcgtccgttcaaagacgtgctgattcacggcttaatccgtgacgagcagggcagaaaaatgagtaaatcccttgggaacggcgtggacccgatggatgtcatcgacaagtacggagcggattccctgcgctatttcctggcaaccggaagttcaccgggacaggatctccgtttcagctatgaaaaagtggaatccacatggaacttcgcaaataaaatttggaacgcctcccgttttgcattaatgaacatggacggcatgacgtatgacgagcttgatctgtccggtgaaaaatcagttgctgataagtggatcctcacaagactgaatgaaacgatagaagatgtaacacagcttgcggatcgttatgaattcggtgaagtcggacgccacctgtacaactttatctgggacgatgtgtgcgactggtatatcgaaatggcgaagcttccgctgtacggggaagatgaagcggcgaagaaaacaacccggtctgttctggcatacgtgcttgaccagacgatgcgtcttcttcacccgtttatgccattcttaacggaagaaatctggcagcaccttcctcatgaaggcgagtcaatcacgatcagctcttggccggttccagtgccggaacatacggataaagaggcagcggcggatatgaaactgctcgttgaattaatccgttctgtccgcaatatccggagcgaagtcaacacgccgatgagcaagcaggttgaactttacattaaaacatctaccgaagacattgccggccgccttgagaagaaccgttcttacgttgaacgctttacgaatccgagcacgctgaaaatcgggacggatatcgctgcggcagacaaagcgatgacagctgtcgtcaccggagcggaagtcattctgccgcttgaagggctgattaacattgatgaggagatcgcccgtctgcaaaaagaattcgacaagctgacaaaagaagtcgaacgcgttcagaaaaaactcggcaacgaaggattcattaaaaaagctcctgagcatgtcattgaagaagaacgcggaaaagagaaagactacacggcaaaacgcgaagctgtccggcagcggattgcagagctgaaaggctgataaaacagcggggcggtttcctaagaaaccgccttgtcgtataaaagaggggatttcattgtttaatacgtacaaagaagcgatcagctggattcacggcagactcaagttcggcgttaagccgggccttctccgtatggaaaagctgatggaaaaactggaacacccggaaaagaacattcgcgccattcatgtggcgggcacaaacggcaaaggatcaaccgtttcttttatccgttccgtccttcaagaagccggttatacggtcggcacgttcacatcgccttacatgattacgtttaatgagcgaatcagcgtcaacggcatgccgattaccgatgaggaatggagaacgctcgttactgacataaaaccgatagtcgatgagcttgataagaccgatgccggaacggtgacggaatttgaaatcattacagcgtgtgcatttttatattttgcgaagcgggctgatatcgattttgtcatttttgaagcggggctcggcggcacatttgattcaaccaatattgtgaaaccgcttctgtcggtcattacaagtatcggacatgaccatatggccattttaggcaataccatcgaggagatcgccgggcagaaagccggtattattaaaaattccattccggtcattacgggcgtcaatcagccggaagcactcggcgttattgaagcggaagccgaaaaaaagcaggctccgtatcagtcactatataaaacgtgcagactgtttaatgaagcggcgcttccgtccggcgaaagcttttcgctggaaacagaaacgaaatgctatgaaaacattcaaacgtcgctgatcggcattcaccaaaggcagaatgcggcattggcgatattggccgctgaatggctgaatcgcctggaggccgcagtcatttcagaagaagcgatgcgaaacggcctgaaaaaagcttcctggccgggccggtttgaacgtcttcaaagccgccctttagtgtttgcggacggcgcccataacgaagagggtgttgaaacgctgacagaaacgatccggcagcgctttgccggtaaaaacgtccatgtcgtattcagcgcattaaaagacaaaccgtatcaggaaatgattaaaaagcttgaaaccgaagcggattccattcactttgtatcatttgactttccgcgtgcttcaagcgccgaagccctttacaatgcaagcagtcttgcatctaagagcttcgatgagaacccggacagtgtgaaagaatggatagaacaaaaagacggggcggatgatgtcatcatcattaccggctccttatattttatttcagagatgagaaagcggcttatctgacagcccctcggatgcccggcagaccattttccggttttgccgggtgtttttatgctgaaaatatattttcagccatttcagtcatggtgtttttctttgctataatctgagccagattgatagtaaaggtgtggtctgagtgcttttaattctgttttttctcggcttgattttcggttcttttttttatacagcagcgtgccgtatcccgctgcgaatctcggttatttcgccgcgttcatcctgttcgttttgccgcttgccgctctcctggggggagcttgtgcccgtcgtctcctatattctgcaaagaggcagatgcagaaactgccgtgcgaagctgtcggttatgtatccggcggcggaatgctggacggcgtgtttattcacggctgcaggcattcatttcggtttctcaaaagaactgttagtcgcgctgttatttctgtctctcctcatgattgttactatgacggatctgcaatatatgctgattcctgacaaagttctgctgttttttcttccgcttttcatcgccggccgtatgttttctccgctggattcatggtatgcggggtttgccggagccgtttgcggattttttctgcttgtttttatcatgtttgtcagtaaaggaggcatcggcgcaggtgatgtgaaactgtttggggtgatcggcctgacgctcggcgtgaagctcgtgctcattgcattctttctttccgttatgatcggagcggtatacggtatgtgcgccgcagcccggggcagtcttggtaaaaagcagccatttccgtttgcgccggccatctcagccgggagcgctttgagttatttatacggtgatgagctgttttcgttttacatcaagctcgcttcaggcggggcttgaaaaatttggcgaacgttttttggacaagacgacaaaagtcttgttcttttttttttcgcctatgctaaagtgtgaaccatgatcagttcaaggtacggccaagacgaatgcaagggggaagagacgttgaaaaaaaggaagagcaaaaagcacagcaaagctaaaaacaatgcccttaaagtaaccattaacggacaagaagaaacgatgtatggacaagaagatgtgaatgaaggcggggagaagaccgtcacattttccaattgggaagaaacaaaaaaggcggaacaggagactgccgcatcccatgaagatccgaaagaagaagatttcaattgggatcatgagaagaattctgaggtatttgaagatgacccgaaagtcgttccgccataccagaagaaaaaaaacggccctcattttccgaaaaaaaagcagccgtcttctccagttaaaaaggcggtcacgacaattgccgttgcggctgttttaggcaccgggctcggccttgtcgccttaaatatgtcgggaagtaaagaagcctccgctccggcatcagctgacaaaggttcacaagggcagacggtgaaagcgggagatgtttctaacgacaaatctgaaacagccggcacaggagatgcggaatcttcagcgggaaactataaaacatatgcggtgcaggccggaaaattttcatcagaaaaaggagcgcaaacgcttgttgaccagctgactgaaaaaggatactcggccgtctctctggcaaaagaagacggatacacatacgtgatcgccgggcttgcagcggaaaaaagcttatcacagcaattgggtcagacactgatagaccatgattttgaggcttggggcggaaaggagctcagctttgcggtcgattcagggctggaagactcttttaaacaggcatctgagctctccgccaaagcgattaccggcaaaaatctttcaaaaacggaagtggctgaagcggcaaaagcggcagacggcgcagacgccgctgacaaaaagcagaaagaggccgtgcttcaagcgctgaaagaactggaaacgtcgggttcggaatccggctggaaagcccaaaaagagcttttaagtgttgtaaaatagtatctcatttcccgtcatccggcgggattttttattttgtcatcaaaaagttatttttctgaaattgtggttgcccgtttgatttggtaggatagacaagtatctttttttcttaagcaaaccctgaaaggatgacaaccatgacaaaacgcttaatactcgcatcacaatctccgcgaagaaaagaactccttaatcttcttcagattccttacagcattattgcgagccgcacagaagaaaaattaaatcgaaacctttcgccggaagaaaacgtccaatgtttggccgagcaaaaagctagtgctgtattggccgaaaatcccgatgcagtcgttatcggggctgacacgatggtgtgcacagacggcgagtgcctcggcaaaccgcgtgacagggaagaagcggcacagatgctgcggaggctttccggccgaagccatcaagtcattacggcggtcagcattcagacgcatgaccggaaagaaacattctgtgacacaacggaagtgacgttttggccgctcagtgaagacgacatacagctctacattgaaacaaaagaaccgatggataaagcaggtgcatacggcatccaaggaaaaggcgcgcttttagtgaaaaaaatagacggtgatttttattctgtcgtcgggcttcctgtcgctaaaacaatgagagccttgaaagaatttaatataaaagcttgatgttcaaaccgggaaggggaacaaggaggggttgatcatccgtgatctgccgttaaaattaagagatttccccgaaaaagaaaaaccgagagagcggcttctgcacttcggagccgaacatctctctaacaatgaattgctcgccatcctgctgcggacgggaacgaaacatgagtccgtcatgaacctcgctcaccggctgctgcggacgtttgacgggctgcgcctgttaaaaggcgcctctgcccaggagctttccagcattccgggaatcggaacggtgaaggccgttcagattcttgccgcaattgagctggggagccgcattcataagacatccgccggggagcattgcgtcatccgctctccggaagacggggcgaagtatgtgatggaggatatgcgctttttaacccaggagcattttgtctgtttatatttaaataccaaaaatcaagtcattcataaacgcaccgtttttatcggaagtctgaattcatctattgtccacccgcgggaggtgtttaaagaagctttcaaacgatccgccgcgtccttcatttgcgttcacaatcatccttcaggagatcctacaccgagcagggaagatatagaggtaaccaggcggctttttgagtgcggaaatttaatcggcatcgagctgctggatcatttggtcattggtgataaaaaatttgtgagtttaaaggaaaaaggatatttgtaacactttttttttcgttgatttaagatataatagattttatgagtttttccctttagggtatttttgctttaagaaaggaagatacatacatatgttcggaattggtacaagagaccttggtatagatttgggaaccgcgaatacgcttgtgtttgttaaaggtaaaggaatcgtagtgagagagccgtctgtcgttgctctgcaaacggatacgaagtcaatcgttgcggtcggtaacgatgcgaaaaacatgatcggaagaactccgggcaacgtggttgcgctccgtccgatgaaagacggcgttatcgctgactatgaaacaactgcgacaatgatgaaatactacattaatcaggctgtgaaaaataaaggattgtttgcgagaaagccgtacgttatggtgtgtgtgccgtcaggtattacggccgttgaagaacgggcggtcatcgacgcgacaagacaagcgggcgcacgtgacgcttatccgattgaagaaccgtttgcggcagcaatcggcgcgaatcttccggtatgggagccgacgggcagcatggtcgttgatatcggcggcggaacaactgaagtggcgatcatttctttaggcggcattgtcacgtctcagtcaatccgtgtagccggtgacgaaatggacgactcaatcatcagctatatcagaaaaacatataatctgatgatcggtgaccgtacggcggaagccattaaaatggaaatcggttcagcagaaaccggtgaagaaaatgcgtcaatggaaattcgcggccgcgatcttctgacaggtctgccgaaaacgatcgaaatcacgggaacggaaattgcaaatgcactgcgtgatacagttctctcaatcgttgatgcggtgaagagcacgcttgaaaaaacaccgcctgagctggccgctgacattatggacagaggtattgtattaacagggggaggcgccctgctccgcaatctcgacaaagtcatcagcgacgaaacgaaaatgcctgttcttatcgctgaagatccgctggattgtgttgcgatcggcactggaaaagcactggagcacatccatcttttcaaaggaaaaacaagataatcaggagttaaatagaagaggtgtatcacgatgccgaacaaacggttaatgctattacttctgtgtattatcatattggtggctatgattggattctcgctgaagaacggccgtaataccacctggcctgaaaagctgatcggtgatacgacgggagtatttcaaaacatttttcacacgcctgccgaatattttgcagggttcttcggggacataaaagacctgaaaaacacgtacaaagaaaacgaacgcttaagacaaaagctggacggacagacacaatatgaagcgaagctccaagaactcaaagatgaaaacaagaagctgcgtgatgaactcgggcatgtcaaatcaatttccgactatgatccgattttagcgaccgttatcgccagaaaccctgatcaatggtacaagcagatcatgatcaataagggaacgaagcacaaagtggccaaagacatggctgtcacgaacgaaaagggtgcgctggtcgggaagatcaaaagcagcggactcaacagtttcacatccgccgttcagctgctgagcgatgttgaccgcaataacagagtggccaccaaaatctccggcaaaaagggaagcaaaggctacggtttaattgaagggtatgataaaaagaaacagaccctgaaaatgaccatccttgaaccggatgaaaaacgtgaagtgaaaaaaggcgacctcgtggaaacctccggaacgggcggcgtatttcctcaagggctgacggtcggcgaagtgaccgatgtagaatcagatgcttacggcctgacgaaaatcgcttatgtgaaaccggctgccgacttgtacgatcttgaccatgtcatcgtcgtgaaccgaagcgtagcaacaggggaggaaggatcgtgaaacgtttccttctccctttgattatgattttggtcttttgtgcggaaagcatctataccgatctggtgcgttttcctttcgtttccgtcgagcagcaggtcgttccgcattttcttttgcttgcgctgatttttatgtcggcttatatcaaccaaaagcatgcggtgatctacggtttcattttcggatttctttatgacatcaattatacgggtgttttaggcgtttatatgtttggttttgccggattatgctatctggcggccaaagcgtttaaagtgctgcagacaaacgccctgatggtcattctggtcgcggtgctgagcgtatgtgtgcttgaattttacgtctacggcattcagacgttaatccgcagcggcactatgacgtttaacgattttgtcattcagcggttcttgccgaccgctttgctgaatatcgcgggagccgttatattagtcctgcccttcaggctgttttatataagtctgaagaaagaattaagagatgagtaaaaaggattttatctttttttgacgaaaagagtgttgttgaggtgaacattgatgaagaccaaaaagcagcaatatgtaacaataaaaggaacaaaaaacggcttaacattgcatctggatgatgcgtgttcttttgatgagctcctcgatggtcttcaaaacatgctgtcgattgaacaatatactgatggcaaaggccaaaaaatcagtgttcatattaaactcgggcatcggtatctgtatcaggaacaggcagagcagctgactgatctgatcgcgtcaaagaaagatttagtcgtgcattcaattgacagtgaagtcatcgccaaagaagaagcgcagcggatgaaagaggagcaggaaattgtttcggtttccaaaatcgtccgttcgggccaggtgcttcacgtgacgggagatttgcttttaatcggagatgtgaatcccggcggtacgatcagagccggaggaaatatatttgttctcggttcattaaaagggattgcccacgcgggttataacggaaataaccgggctgtgatcgccgcatccgaaatgatgccgacacaattgaggatcaatcacgtgttaaatcgctccccagaccacattcagaaagggaacgacatggaatgtgcttatttagatactgacggaaatatggtcattgaacgccttcagcaattggctcatttaagacctgatctaacaaggcttgagggaggaatgtgaaattgggtgaggctatcgtaataacttcgggaaaaggcggagtaggtaaaacaacaacatctgcaaacctcggtaccgccttagccattttagggaagcgcgtctgtttggtagacacagatatcggactgcgcaaccttgatgtcgtaatgggtcttgaaaacagaattatttacgacttagtagatgtaattgaaggccgatgcaagactcatcaggcgcttgtcaaagacaaacgttttgatgatctgcttcatttaatgccggctgcccagacaagcgacaagacggctgttgtccctgagcagatcaaatcgcttgtgcaggagcttaagcaggaatttgattatgtcattattgattgtccggcgggaattgaacaaggctataaaaatgccgtctccggagctgataaggcgattgttgtgacgacgccggaaatatcagcggtgcgggacgctgaccgcattatcggacttttggagcaggaagatatcgaaccgccgcgccttatcgtgaaccgtatcagaaatcacctggtgaaaaacggtgacacgatggatgtggatgaagttgttcatcatctgtctattgatctcctcggaatcgttgctgacgatgatgaagtgatcagggcttcaaatatcggcgaaccgattgccatgaattccaaaaaccgcgccagcattgcgtaccgcaatatcgcccggcgcattttaggagaatccgttcctttgcaggtgcttgaagagcagcaaaaagggatgatggcgaaaatcaagtcatttttcggcgtgcgttcataatatataccagaatacaaagatctgatgaagcccagcttatcaggtcttttttgttttttaagagcgcatatttgcaatggacaagacataggatgtacaaacccaacgattgcaaaggatgatggcgatgagtcacagagctgatgaaattagaaaaagactggccaaaagaagaaaacagcggcctgaatcaaaacggactttcgttcaaaacgctcaaacgcagaattttcccgcgtggcagacggtcaaggagcaggaaaagcacaagcttcttccggactacgaatatcaaacggaacacccgcccgaatttaacgggcggcatccattgatcagcgctcattctattattttaaaatgcctgctggccgcctgtctcgtactaatctccgctattgcctataaaactgacaaacagccgctgagtcagatcaaaccggcaatcgcacaaacctttcaaaaagaatttcagtttgctgccgtaagcaattggttcgtatcttccttcggaaacccgctcgcttttcttacgccgggaactaaaaagaaggacggtcaggtggcggtcagtcaggatatggccgttcctgccgcggggaaaatccagcaggactttcaaaataacggagagggcgtcgtcgtcgaaaccgccagtgaagccattgacagcgtaaaagaaggctacattatggaagtgagcaaagataaaaaaacagggctgacggtgaaggtgcagcacgccgacaatacaagcagcatttacggccggctgaaagatgttaacgtttcattgtacgactttgtcgataaagggaaaaagatcggttcgatcaagctcaacgataaaagtaaaggccagtactatttcgcgatccaggatggcgataaattcatagatccgatccaggtgatcacatttgatgaataaatggctcatcctcctttttaaaattcatgtccatccttttctttggattattatggggctcggtcttatgacggggcacatcaaagcgctgctgtgtcttttgctggtcgtatccgttcatgagctggggcatgctgctctggctgtgtttttttcgtggcgcattaaacgaatctttctgctccctttcggcgggacggttgaggtggaggagcacggaaaccggccgcttaaagaggaattcgcggtcattttggcgggcccgcttcagcatgtgtggcttcaggcggcagcctggctctttttcatgtcaggctttgcaagtgagcagacatttgagatgtttaccttttataatctctccattcttttcatcaatcttttgccgatctggccgcttgacggcggcaagttcgtgtttttatacttctctaaacaaatggcttttcaaaaagcgcatctcctcagcctgcagacatcggccgtttccgcgcttttgctctgctgctggattgtgctggccgtcccccttcaggtcagcgcatgggtgctgttcgtctttctcgccgcttctttatgggatgaataccggaagcggcattatattcagctgaggtttcttttggagaggtactacggcaaaaaccgcgatgtcgccatgctgcatcctttgacggtcgcggccgatgccaaagtaaagcatgtcatggccgaattcaaacggggatgcaagcaccccattatcattgaaaaagccggcgaaaagctcagccagctcgatgaaaatgaagtgcttcatgcgtattttgccgataaacggacagattcctctatggaagacctgctgctgccatactagaaatagattgacatatccttttggttctgatatattttttaatgttatggatgtagcaccaatgctacaaccgctcgggacaggtgataagagctttaaagccccctgttgctggcgagtcttagtctaataggaggtgcagagaatgtacgcaatcattaaaacaggcggaaaacaaatcaaagttgaagaaggtcaaactgtttacatcgaaaaacttgctgctgaagcaggtgaaacagtgacgtttgaagacgtattgtttgttggcggagacagcgtgaaagtcggcaacccaacagttgcaggcgcgacagttacagctaaagttgaaaaacaaggccgtgcgaaaaaaatcactgttttccgttacaagccaaagaaaaatgttcataaaaaacaaggtcatcgtcagccttatactaaattgacaatcgaaaaaatcaacgcgtaagcatgattgaggcaacaattcgaagatcccggaatgacgggggcattttgtcctttgaaatgacgggacatgccgattttgctgaacatggacgagatctcgtttgcgccggggtcacggctgtcgttttcggagcggtcaatgcggttatcgcgctggctcctctcgaaccgattcttgatataggcgaggacgggggttatttctattttgaattccctgaagccgctgatcaggaagctttgcaaaaagcgcagctgctgattgaaggcatgattgtttctcttgaaacgatcgagcgggattacagtgaacacttacggttgactgcaaaccaaatataggaggtgagttacatgcttagattagatcttcagtttttcgcttctaaaaaaggtgtaggttctacaaagaacggacgtgactctgaatctaaacgtttaggcgctaaacgtgcagacggtcaattcgtaacaggcggatctatcctttaccgtcaacgcggaacgaaaatctacccaggtgaaaacgtgggccgcggaggagatgacactctttttgctaaaatcgacggaactgttaaattcgaacgtttcggccgtgaccgcaaaaaagtgagcgtatatcctgtagctcaataatgacacaaaaaactccggtcgttgactggagttttttttgcagtaagcggagtaacatcaagaatgaaaagcagaggatgcgtgagtgaaccccgccttgaatgaggacatcagcttctcatacccactggatatgttccccaagcagtgataccaaaaatgtttctgcctggcatccgcattgtatgcgatccgaaaaaggaacatgatgaaccaggaaaaacaagtgtttttttaacaaagccttctctgttataattcatagtacacacttatcaagactcctaaaaagaaattaaacgattgggagtgcgaaaatgaaggatgtatcgaagaaacaagaagaacctgtaagcgatgcggctctgatcaatgaactgatccaattaatgggccatttccgtcatgattggatgaataagctgcagctgataaaaggaaacttaagtttgcagaagtatgacagggtcgttgaaataatcgacgaaatggtcatagatgcaaagcacgagtcaaagctctcaaacctgaaaaccccgcacttggcgtttgactttctgacatttaattggaagtcccgttatatgcggctcgaatacgaagtgctcggagaaattaaagatttatcggcatatgatcaaaagctgtcgaacctgatgagaaaactgtttcatctgttcggtctggcggtaagcaatgaaagtgaaaatcatctgaccgtatcgctgcagacggatcaccctgacagacagcttattgtatatctcgattttcatggaacgattgcaaatgcagatgtgtttgatgaatttcgcaaatcgcggtatgaggactttgatgtcatgcaatttgagctgaccggccatgaatgtgtggccgaaattggaatgaactagcggttttttacggtttagaacggaggatattatgtttgtagatcaggtgaaagtatatgtaaaaggcggcgacggcggtaacggaatggttgcgttccgccgtgaaaaatatgtgccgaaaggcgggcctgccggcggtgacggaggtaatggaggcgacgtcgtttttgaggttgatgaaggactgcgcacgctcatggacttccggtaccagcgccatttcaaagcgatacgcggcgagcacggcatgtctaaaaaccagcacggcagaaatgcggacgatatggttgttaaagttccgcccggcacagtcgtaacggatgacgatacaaaacaggtcattgccgatctgacagagcacgggcagcgcgccgtcatcgcaaaaggcggacgcggcggacgcggaaatacccgctttgcgaccccggccaacccggcgccgcagctgtcagagcacggagagcccggaaaagagcgctatatcgtgcttgaactgaaagtgcttgcagacgtaggtctcgtcggcttcccgagcgtcggaaaatctacgcttctgtctgtcgtttcatcagcaaagccgaaaatcgccgattatcattttacgacgcttgttccgaatctgggcatggtggaaacggatgacggaagaagcttcgtcatggcggacctgcccggtttgattgaaggagcgcacgaaggagtcggcttaggccaccaatttctccgccatatcgaacggacgcgtgtcatcgttcacgtcattgacatgtcagcgatggaaggccgtgatccgtatgaggattatgtgaccattaatcaggagctcagtgaatataatctgcggctgacggagcgtccgcaaattatcgttgcgaataaaatggacatgcccgaagcggctgaaaatcttaaagcgtttaaagaaaagcttcaggatgaccatcctgtcttcccgatcagcgcggtgacgagagaagggctccgcgatcttctgtttgaagtcgccaaccagctggaaacaacgcctgaattcccgctgtatgatgaagaagaactggcggaaaaccgtgtaatgtacacgatggaagatgaagaaattccatttgacattacccgtgatccggacggcgcgtttgtgctttcaggtgacagtctggaacgtctctttaaaatgactgacttctcccgtgacgaatccgtcaagcgttttgcaagacagatgcgcggtatgggcgttgatgaagcgctcagagagcgcggtgctaaagacggcgatatcatccggctgctggaatttgaatttgaatttattgattaaaaagacggagagcttgcaatgcaggctctctgatgtaaaagggaggggtgcaggtgaaagaagagacattttatttagtgcgtgaagacgttctgcctgatgcgatgcggaaaacccttgaagtcaaaaagctgctcgacagaaaaaaggctgaatcggttgcagatgccgtgcagaaagttgatttaagcagaagcgctttttacaaataccgagatgcggttttccctttttacacgatggttaaagaacaaataatcacacttttctttcatttggaggatcggtcaggcgcgttatcccagcttttgcaggcggtggctgactcaggaagcaacgtgctttccattcaccagacgattccgcttcagggcagggcgaatgtcacgctctcaatcagtacgtccgcaatggaagaaaacattcatacgttaatgaataaactgagaaaatttgattttatagaaaaagttgagatcttagggtcaggcgcgtaaggagagaagagacatgaaagtcggttatttagggccagaagccacatttacacatctagcagtcagttcctgctttcaaaacagcgtgacacaagcaccttatcaaacaataccggcatgcatggatgcggcggttgcgggagaagttgatcttgcatttgttcctttggaaaacgcgctggagggctcggttaacttaacgattgactacttgattcatgagcagcctcttgcgatcgtgggggaaatgacgctgccgattcaccagcatctgctcgttcacccttcgagagaaaatgagtggaaaaagcttgagaaaatttattctcattcccatgcgattgcgcaatgccacaaatttcttcaccggcatttttcgtccgttccttatgagtatgcgaagtcaacaggtgcggctgccaagtatgtcagtgagcattcggaccttccgatcggcgtgattgcaaatgaaatggcggccgctacatacggattgagcatcgtgaagcgggatattcaggattatcaggacaaccacacgagatttgtcattctttcgcctgaaaaagacgtctcattcgaagtgaatgcgaaactgtcttcacggccgaaaacgacgatgatggtaacgcttccccaagatgaccaatcaggcgcgctgcacagggtgctgtccgctttttcatggagaaacctgaatttatcaaagatcgaatcgcgcccgaccaaaacgggtctcggcaactatttctttattattgatattgaacaggcgatggatcaggttctcattcccggtgccgttcaagagatggaagccctcggctgccgggtcaagcttctgggaacatatcaatcctattcgatataaaaaaagctccccttcagggggctttttttttaatcttttattaaaatacccgcgtcgtccagcgcttggcaggcttggtcaatccgctcttttgtcggggcgcttaacgtatggagatgcacgcctccggtcagctgtgaaaggtaagcggcatttgtcgagttaatgtgatccatgaattgtttgacttctttccgtgtgctgactcttatggcggcggttaaatcgccgtatacggggtgttcaataatgacgtcctttatggtgacgccttcatcgacaatgagttcaagctcttcttccgtccgctccgggccgtgcagacaggcgacaatccgttcggcgtttttttcgccgccggtattcatgctgatgtataaatagccttggctcgtcgcgataatcggttcgctttttgctttcaagagcgatatgtcctgcacgatcacctgtcttgaaacatttgcttttttggccaattcgcctcctgttaatggcgagccggcttctttcagccaatgaagcagcatgtcgcgtcttttcgccccagtaagcttcgttccttctgtcaaattgctgattctcctttcttttgctcccatagcgctgtaaatgtatgtatcagcatatcgagctgttcacatgttgtttcgtttccgaatgagatccggaaaaactgccgcgcttcccgttcggtttttctcagcgccttcatagctgaagaagggccgtggctgccggcggaacatgcgctcccggttgagatgcaaatatcgttacgattacattctaacataatatattgtccttcaaaggagtgaaaaaaacacccgacaatgtggggcaggcattcaccgccggtttctttctctgaaaatgaaatggggaggccttgacgccgaatttggtcatacaaataattcctcagcctgtcagcatgctcacggtgttcctccatatgtttcactgcatactccgcagcagcggtaaaagcgccgatggccggcacattcaccgtaccgggcctgaacccgttttcatgcacggtatgcggataaaccggattccagctgacaccgggccgaatgtaaacagccccggtgcctttcgggccgtatactttatgaccggagacggaaagggcgtcgattcccgcctgatccgcatcaatcggcagtttgccgaaactttgaacacaatcgcaatgcagtaaaatgtttctctggtgaagaaaagcggccaggcgattcacaggctggatgaggccggtttctgaattggcgtgctgtatggaaacgagccccgtgtcaggacggatatgagccgccagtatgtcctcggttataaggccgttttcgtcgggatatatgatggtgacatcaattccccggtaagctaaaaacgccgcggcattatggatcgagtggtgttccattgcggtcgtaataaaatgttttttatgatcaggcagaccgtacagcaatgattggacggccaagatgttcgattccgttccgccgcttgtaaagtgaatgccgtctgccgctccgccgatcaattttcctgcagaatgtctgcaatattcaagcacgtccgccgctcttcctccggcgtcatgaaggctgctagcattgccgtatacctctgtgctgagatgctgaaagactttcgcggcttctttgcttaaaggcgttcccgccgcgtaatcaagataaatcatacagcccgtctcctatccgtttatgttaaaaaaagcttgagtttattttatcgttgtgtaaatataggtgtcaagacaggtgtaaatataatgggagggtgatgtatgtctgaaaaaacaattatcgtcattggtacggggacggcggcccttgcctgtgcttcctcatttcctccgtcataccaagtaaccgtcatcacaaagagaaacgtaacgaacagcaattcgcattatgctcaaggcgggattgctgtttcatacgcaaaagatgactcgatagaatcccatgtgaacgatacactgtatgcgggatgcggacacaatgacgtgacagccgtgcggcatttgctgcaaagcggacagagcatgataaacaggctgatagaaggccatttcccttttgatacgaagtcggacggaacgttttgtctcggcagggaaggcgctcattccaaaaggaggattctgcacgccgggggagatgcgaccggacggatgctggttgagtttctggttcggcagctgagggacggcattcggatcattgaacacgagacggttgttgatctgctgattgaacacgggcgatgcgcaggcgttgccgtaaaggatgcttcaggcgccgtttcttacagaagagcggattgtgtagtgcttgcttcaggcggctgcggcagtctgtaccaatatcacacaaatgattccgccataacgggagacggcatcgctcttgccttccgcgcgggagctgagatcacggatatggagttcacccagttccacccgaccctccttgtgaaaaacgggactgtgtacggtctgatttctgaagcagtgagaggagaaggcggatatttagcggatcgcttcgggcgcaggatcatggctggcagacacgcgcttgaggatttggcgccccgggatgtggtttcacgggcgatttatgaagaaatgatgaaagaaaatcctgtttttataaattgcagccgaatagccgattttaacaaacgttttccgaccataacagaaatttgtcaaacagccggcgttgatcttgaaagcgggatccccatagcacccggaatgcattttttaatgggcggagtaaaagccgatacatgggggaaaacgtccgtgcctgatttgtacgccataggcgagaccgcctgcacaggcttgcacggggcgaaccgccttgcgagcaactcactgctggaagcgctggcaagcgggcaacgatgtgctgaacatatcattcaaacaccgttaaacggaagatataaaaaaaccccgaagaaaactgatgtcatcttacaagtgccggacacaacgattcatgtgcttcaagccaaaatgacaaccggagcgggtatcgtcagggaaaaagaaaacctgcaggcgctgacatcctggcttaacaacgtatctgtgcatcatataaatgtgaaggatatcacaatggaacaagcagagctatcctgcctatggaagactgcgcaacttgttgtcacctcagcccttattcgggaagaaagcagaggcgctcattttcgcactgattttcccgggacggagaaagattggcacggaaaacaaatcattcattcaacatctggaacggttatcagaaaaaacgaaaggattggggaactatggacattctgcagctgaaacaaatgctgactcatttttttcaggaagatatcagaacgggtgatgcgacgtcacaagcgattttttctgatcagcaatgtaaagcgcggatcatcgcaaaaacagacggcgtgtttgccggagaagacgttatccgtgaaggatggaagcttttacacgatgatatccgcatccgccctctgaaaaaagacggagaacggatgaaaaaaggagacgtgctcgctgaaatggaaggccgggcggcagctcttcttactggggagcgggtcattctgaatctcatacaaagaatgtcaggcattgcgacaatgacggacgaggctaaaaggcgtcttgatgatccgtccattaagctttgtgatacgagaaaaacgacaccggggctcagaatgctggaaaaatacgccgttcgggtcggaggcggctttaatcatcgcttcggcttatatgacggcatcatgattaaagataatcatattgccgcctgcggatcgataaaggcggccgtggagcgggcaagagaaacggcagggcagatgcttgcggtggaagtcgagatcgaatccgaacagcagctgctcgaggcaatagaagcgggcgcagacattattatgtttgacaactgtccgcctgagtccgtccggcgttttgcaggcatgacaccgggccatatcaaaacggaagcatccggaggcataacgctcgacacattgcccgcttataaagggacgggcgtccaatatatttcactcggatttctgactcattcagtaaaaagcgccgacatcagcatggatgttgaggctgcggaacagggggatttttaagatgtctatttttgacgtgttaactgcatcagccgaaatgatgccgagccattataaagacatgagcaccggagaaatggaaaagcgtgtcgccgccattaaacgggatttcggaaagcgcctgttcattccggggcatcactatcaaaaagacgaagtgatacaattcgccgatacggcaggtgactccctgcagcttgctcaagtggctgaaaaaaataaagaggcggaatatattgtgttttgcggcgtgcattttatggcggaaaccgctgatatgctgactgatgataaccaaaccgtcattttgcccgacatgcgcgccggatgctcgatggctgatatggcagatattcagcagacggacaaagcatggaaagagcttcaagaactgtacggtaacaccatcattccgttaacatatgttaactcgacggcggaaattaaagcattcgtcggtcggcacggtggagcgaccgtcacctcttcgaatgcccggagtgtgctgaaatgggcttttaaacaaaaagaaagaattttatttttgccggatcagcatttaggcagaaatacagcctatgacctcggcattccgctgacagaaatggctgtatgggacccggggcagaaccgattgcttactgaccatccggaaaacattaaagtcatcctttggaaaggacattgctccgtacacgaaaagtttacagcggaaaatatttctcagctgcggcagcgggattccggcatccgcattatcgttcatccggaatgttcgcgggaagtggtctcgctcagtgacgacagcgggtctaccaaatatattattgatacgattgaacaggctgaaccgggaagcaagtgggcgatcggcacggaaatgaatcttgttcagcgcctcattcactcgcacccggataaacagattgaatcattgaatcccgatatgtgtccgtgtctgacaatgaacagaatcgacctgccgcatttattgtggtcgcttgagcagcttgaaaaaggcgagccgaagggtgtcattaaagttccggaagcggttcggacagaagcgcttcgtgctttgaacagaatgctgagtcatacgtaatcataaaaatttcccctccttcccaaattttttatcatcatgcccagtccaccggcatatagtgtgaagaaacgtattgtaatgacaaatgtaccgttcacgttttgtgcataggaggggaaaacgttgaaaattcatatcgttcaaaaaggcgattcgctctggaaaatagctgaaaaatacggagttgatcttgaagagttaaaaaaactgaatcatcagcttagcaatccagacttaattatgcctggaatgaagataaaggtgccttcagaagccgttccggtcagaaaagaacccaaggccggcttcggaacgtctgcgcataagcatgagcatccatatgccaaagaaaaaccgaaatcagttgtggacattgaagacaccataccggaagaaccgaagccgtcaattccgtatgtgccgccaatccctgaaaagcatgaaaatgtgctgccggaagctgatatgaaccaatattatccgtccaatcagctgtttcagccgtggtcgcctcctaagccggaggaaccggtgacacattttgtcgagccgaaagaaaaagagcatgacaataacattccacaacaggaggaaatgatcaacatggaaaacgcgaattacccgaatatgccgaaggcgcctgaagccggaaagatggaagaagaaaacgccgcttatcatctgccgaacatgccaaacattccgaatgtcccgtttccgaatatgccggccgttgaaccgccttttatgcattacccgatgccgtgcatgccttgtccttgtccggttccggtgacaccgatgctgccgggttcgggactatgccatccgtgcttcccggtaggcggaggtttcggcggttttggaggaggttatggaggctttccggtaatgccgatgccgttaccgtacggattccatcatcacggattccatcatccgggatttgggccgcaagcgggttacggtgaatatgaaaaccaggcccatgaaaatgcagagcattatgatggtgcatccggtttcggcggtgctccgtacggtcaaatgccgtattacggcggatattcgtcacattacgcaaacgcgcctcatcatgatgggaaatttaaggatgatgattgcggctgccatgattcacatcaccaccaccatcatcaccacggttcacatcaccatcacgcaaatatgcctgtgcagccgtatccgaatatgggtgcaaacgccggatattttatgccttacggcggagcaaatcctaatgccgcaccgaatcagccgagtccaaatcaagtattcggacggccggaggaagaagaagattaatgtttcgggacgatgtatgtcgttcctttttttatgtccaactgaggaatggacataactgacaagcttaaacccgccgtcggccgcacatcctaaacatgagcggaaaacgctcaaacagcgatgaatccacggggggtttttccattgggtaaaaaactgatgacgatcgcaggcgttttagccgtgacggcaagcttaacggcatgcggagcaaataatgccatgaatgacggacgctacaatcagtcaacacgtccggtcggatattattcgaatgataatgataacggcagacgccagtacggaatggaccatcaaggacccgtttctgaaatgatggaaaaccgaaacggccgtcataatacgacaaacgtgtctgaccagtatgcgcctaatgacggggttccgttaacgacggacggcacatataacggccgaaatgtcaatacgccgccggcagctatgtcttataatgggtatgacaacgccgaaaacatcaggctggcggcaaaagttgcaaaccgcgtgaaaaaagtaaaaggcgtacaggatagtcaggtcatcgtgactgacacgagagtcgtcattgccgtcagaacaaatcatccttttacgaaaaatgatgataaacatgtcaaacatgcggccaaaagatttgcggacggccgtacaattcaagtgtttaccgacaacgctacttttacaaagctgcaagacatgaacagaaacagccgttaaacgggactgccggatgatttcatccggcagtatttttatggataaagcttcatcatttctttacatattcttaaaacgctctttatgttgcggtgttaacataaaagtaataaaacgtaacggaggggccggaatgaaaaaaacggagcatgacaaaagccgcggagaaaaaactgtgtatctgaccgtaaggggataccggctcaaactgacgtccggacaaatgcaactgatttcagccggccgggcataatcatcggggcagccttcataatagaggctgctttttttcggctgaaacagacaaatgaaagaaaacggttaagcaccggcatctttggtcaaactagcatcaagagtttgattgaataaagaggtgttattggtgaaacgaatttgcggtgctcgtctattgtttatgcttatcttatcggctgcagtcctgatttgcggaggaaaaggcgcatacggggcggaggttgagcattacgggccgcttcgggtgcacgtccagctggaaaaggtctatctggacggtgatgtcggcatcgaacatacggatgaaaccgttttggcgatggaggatttttgggccgcatatgcgggctggacgctcgttgagcagaaaaaaggcttcgttcttttccgtaagcatgttgatgacatttctccgctcagtaaggttaacggttatatcggcgtcacggacggaggcgtcatctccacttttcacggccgtcccggatcgctggccgagccgatccaatctttcttccagattgatatagaaaggctggaaagccgattgcaaaagcacttggaacacggcataccgtacaggacaaaagcggagtttgagagcgtgatcgatcatattaagacttacagcggatgactttgacgcaagacatgtgacacatgtcttttttttctgaatggaagatgtcaaagcgaacatacgttaacttttctataagactttggctgtttttgtgttacaatgataagcagtcaaagaggtgaataggtgtgattgaattcgtgaaggggacgattgattatgtatctccccaatacatcgtgattgaaaacggcggaatcggctatcaggtctttactccgaatccgtttatttataaggtaagcaatcaagagaccatttttacgtatcatcatataaaagaagacgccttttctttgtacggtttttcaacccgggaagaaaaagcgcttttcacaaagctgctgaacgtcaccggcatcgggccgaaaggggcgctcgccatcctcggttccggtgaccccggagccgtcatcgaagcgatcgaacaggaagatgaagcctttttggtgaaatttccgggtgtgggcaaaaaaacggcgcggcagattattcttgatttgaaaggcaaactggccgacgtcgtgcctgaaatgattgacaacctgttcaatcatgaagcgcgcattgaaaaacaagaggctgaaacggcgcttgacgaggcgcttgaagcgcttagggttctcggctacgccgaaaaagaaattaaaaaagtgcttcctcacttaaaagaggaaacggcgctctcaacagatcaatatgtgaaaaaagcattgcaaaaattattaaagtaaggtgatgttcatggatgaacggctcgtttcaagtgaagcagacagccatgaatcaataatcgagcaaagcctcaggccgcagaatctcgcccagtatatcggccaaaagaaggtgaaagaaaatctgcgcgtgtttatcgatgcggcgaaaatgaggcaggaaacactggaccacgttcttttatacgggcctccgggtctcgggaaaacaacgcttgcgtctatcgtggccaatgagatgggggtggagatgcggacgacgtcaggtcccgccatcgaaagaccgggagatttggcagccattttgacggcgctcgaaccaggggatgtgctgtttatagacgaaattcacaggctgaaccgctcgattgaggaagtgctgtacccggcgatggaggatttctgtcttgatatcgtcattggaaaaggcccgtccgcccgctccgtccgtctcgaccttcccccttttacgcttgtaggagcgacgacaagggtcggattattgaccgcaccgctcagagaccggttcggggtgctgtcgcgccttgaatactatacgcaggaagagctgacagatatcgtgtcaagaacggctgacgtttttgaagtggatatcgaagaagctccggctctggagatcgccagacggtcaaggggaacgccgcgggttgcaaaccggcttctcagaagggtgagagattttgcccaggtgctcggcgacagccgcatcacggaagaaatcgctcacgacgcgctcgaacgtcttcaagtcgatgcgctcggccttgaccatatcgaccataagctgctgatgggcatgatcgaaaaattcagcggcggtcccgtcggccttgatacgatttccgcgacaatcggcgaagaaccgcatacaatagaggatgtgtacgaaccgtatctgctgcagatcggatttcttcagaggacgccgaggggacgggtcgtgactccggctgtgtatgaacattttcgattggaggcgcccgcccgtgactgactttccgaaggttctcatggttctcggtgccgttttgcttattgccggcgcagtctggcactttgtcggaaggctgcccggagatattttcgttaagaagggaaatgttacatttttctttcccgttgtcacttgtattgtgatcagtgtgatactatccattctgcttaattttttcggcagaatgaaataacaatagacagaataaaggtgaaatgatgaaagtcgatttatttgattttgaactgcctgaacgcctcattgcccaagtgccgctgaaagagcgtgacgcatcgcggctgatggtgctcgacaaacagacgggcgggctgacggacagttcatttaaagagattgtaagcttttttaatgaaggggattgtctcgtcttgaacaatacccgtgtgctgcctgcaagattattcggcacaaaagaagatacgggagcgaaagtggagcttctgttattaaaacaggaagaaaatgatacatgggaaacgctcgtaaagccggcgaaacgcgtaaaaaaaggaacggtcctgacatttggcgacggccggctgacagcggtctgcacggaggagcttgatcacggaggcagaaaaatagaattccggtatgacgggattttttacgaagtgcttgaatcactcggtgaaatgccgctgcctccttatattaaagagcagcttgatgataaagaacggtatcagaccgtcttttcaaaagaaatcggatctgccgcagctccgacggccggacttcattttacggaagagattctggacgagctgaagcaaaagggtgtgcggattgaatttatcacacttcatgtgggactcggcacattccgcccggtcagtgcggatgatgtggaagagcataacatgcacgcggaattttatgaaatgacggaagaaaccgccgcctctttaaacgaggtcagaaaggcgggagggcgcatcgtgtcggtcgggacgacatcaacgcgcaccctggaaaccattgccggcgagcatgacggcgtatttaccgcttcaagcggctggacgtccatcttcatttatccgggatatgaatttaaagcgattgacggcatgatcaccaattttcatctgccgaaatcttcccttatcatgctcgtttctgcgcttgccggcagagagcatgttctttccgcctaccgtcatgcggtagaggaggaataccgtttcttcagctttggcgacgccatgctgattatctaatttgaatgacaggaggcctcatacaaagtggctgaacaaccgatacgttatgaatttataaaggaatgcaaacaaacgggagcgcggctgggcagagttcatacgccccacggctcctttgagacgcctgtatttatgccggtcggcacgcttgctacggtaaagacgatgtctccggatgagctgaaatctatggatgcgggcattattttaagcaatacgtaccatttatggctccgcccgggacacgacattgtaaaagaagcgggcgggcttcataagtttatgaactgggaccgcgcgattttaacagattccggcggttttcaggtcttttcattgagcaagtttcgtaatatagaagaagaaggtgttcatttccgcaatcacttaaacggagacaagctgtttttatctccggaaaaagcgatggaaattcaaaacgccctcggctctgatatcatgatggcgtttgatgagtgtccgccgtatccggcagagtatgattacatgaaacgctctgtggaacggaccagccgctgggcggaacgctgcctggaggcgcacgggcgctcagatgagcaggggctgttcggaatcgtacagggcggagaatacgaagacctgcggacacaaagtgcaaaagacttggtttcgcttgattttccggggtatgccataggcggattatctgtcggcgagccgaagcacgtcatgaaccgagtgcttgagtttacaaccccgcttttaccgaaggacaagccgagatatttaatgggtgtgggttcaccggatgccttaattgacggcgccatccgcggcgtggatatgtttgactgcgtactgccgacccggattgcccgaaacggcacggtgtttacgaatgaagggcgtctgaatatgaaaaacgccaaatatgagcgtgatttccgtccgattgacgaagagtgcagctgccatacatgccaaaattactcccgcgcttacatcagacatttgatccgctgtaatgaaacgtttggaattcgattaacaacttaccataaccttcattttctgttacacttaatggagcaggtcagacaagccatccgggaggatcgtcttggtgatttccgagaagagttctttgagcgttacggctataataagccaaatgcgaaaagcttctaaataaaaccattcatgaaaggagggaaacagatgggtactttaggcacaatcgttcctattattttaatgtttgcagtgctttatttcctgctcatccgtccgcagcaaaagcagcagaaggccgtccgccagatgcaggaagagctgaaaaaaggggattcagtggtgacaatcggaggattgcacggcactgttgattcaattgatgaaagcaaggtcgtcattaaaacaggtgataacacccgtttaacatttgaccgccgcgcaatcagagaagcttccgctgaataacagcgaagctcatacatacaaaaaaagagcggagaatccgctctttttttattacgctgatctgcttcctttcaaattcactccgaaaatgccgcccagcatactgactcccaaaaagccgagatgaaacaaaagctgaccggatgtaaacgtttttccgaaccctaaatattgaaaaagcaagatgattaatgaaaaacagacggcggttaacgctccgatcatccagcctttttccttcgctttgccgcccgctataaaacctcccgcaaataaagaaagaaaagaaagcgcggtgatcagccagctgaaagatgattcttccattgaggtgactgtcagtaaaagcgaaatcgccaaactcgtaagaagcatcaccgcaaaaatagccactaagccgtacaagacgcctcttcccacttgtttcgtttcttccatttttatctcctctccgctctgcggcctgatatatgacaagccggagcccgtctttttctaaatgtattctctgaatgttcgaattagacgtaaatgcatgatgttcagcccgtttcttacataattcagagccgatggcaaatgctatgaccgttggaggtgcgatatggaagatattttcattattacgtttcgtacgattgtgctttattttatcattcttgtgattttcagactgatgggaaaacgggaaatcggagaactgagcattttagaccttgtcgtctccattatgattgccgagattgccgtattggcaattgaaaatgtaaaagataagcttttgcatacaattgtgccgattgtcgttttaatgattattcaagtaagccttgcttttatttcgctcaaaagccaaaaaatacggcagctgcttgacggaaaacccaccattattataaaacagggaaaaattgatgaacgggcgatgagatcgcagcgctacaattttgacgatcttcttatgcagctgagggagaataacatcgatagaatctctgacgtgtcgtacgccattttggagtcttcgggcaaactgtcaatcgtcaaaaagaaaaacaataaggataagcagatggaaacatcgcttatcgttgacggggtcattcagaatgagcatctggacagaatcgggaaagataaacactggcttgaaaaaaatttagcaaaaagaggatatcgcgatctttcggttatatcattctgcacgtttacggacggcgctttttttattgatctcaaagatgaaaaaggggagccataaatcggtttcaccgcgtcacgaacttgccgatgaccggaatccggatcagctcttcccttttaatcagcctgaataacagaagaagcgcaatgtacaaaatcgcggtcattgcaatccagcctgtgagattaacagcttctgatcctgaaaaatgaacggtgtgcttgatgatgcggctgacataaccgcaaatgaatatgacggcaaaacagagcgcgtattcttttattttaatgctgatcggaagcaccttgcttacggtggccgcatgcagcagggtgacaaggaccatccccgttacaatcgcaagtgcggcgcccatgatgcctaaggaaggcctggtcgccaaaacaaaaattaggccggttttgacagcggcgccgataaaactgttcatcatggcggccccggctaaattgagagcctgcagcaccgcctgaagaggcccctgaaaatagtaaagcagaaaaaacggcgccatcactttaacaaataccgccgcattagttgatccgtacatgacggacatcagttcatcagcgaaagagaataaaataaccaccgaaatgcctccgcttaaaagacacagcctcatcgcctgttccagacggtattcgacaacttgcagctttttttgctccattccttcactgatcgcaggaacaagcgccgttgacagagaataggttataaagctgggcagcgtcaaaaccgtcatggcaaatccggtcagctccccgtactggctggtggcggcagcggtggccactcctgcaatcgcaaggctctgcgcgacgacaataggttcaaaaaaccaagataaatttccgatgaagcggcttccggttgtcgggagcgacacgctcatcagctggcggaaggtttcttttccatttgcaatcgacttgaaaaattgttttctgattctgattgttttatttgctttaaaacaaatgaataaataaattagagaggcaagctccccgatgacagacgaaatcatggctcctgctgcggcatattcaatcccgtacggcagaaacaccgtcgtgcagactgcgacaagtgaaatccgcacgatctgctcaagcacttgggaaaacgccagcgggttcatattctgcctgccctgaaagtaacctcgcagcacgctggatatcgcgataatcggcacgacgggcgtaatcgccagaagcgggtaaaccgtgcgctgatccgtcagcatcgtttctgacataatcggcgcaaagcataaaaacagcggcgtgaagatgagacttaatatcccggtgacggtaagcgccatcactaaaatgtgtttcattttctgccggtccccccgcgcgcttgcttcagcgacaagtttgctgatggcaacggggaggccgaattgagtcaaagtggtggccaagaaaaatgtcggggcagccatcatgtataaaccgaccccttcttcaccgataaaccgggcgataaccacccggttgacaaagccgagcattctcgtaatcatcccggctgcaatgagaataagagtgccccttaaaaaagtctgttttgccattttataaacccctgccttctcaaactacctggaatcatatacaataaagatatgcgccgatgtcgtccgagcatgacaagtcttcgagaaaaatggaaaaaggagcgagcgcccagtggagaaacatcccgccgaaatgtacaaagatcatttgcggcctttcttgtacagtaaacttgaagagttcaaaatcctcggatacgatgatgttgagcacgagagtttatggtcatacttaatacataaaaagtggaaacagaaaaaggaattgccgctgcatgaattggccggtaatattttatcagttaaaattggcgattttatgaactatgcaaccgttgaagcttttaagtcgtctaattggctggaaagcgatgagggtcaggaagctttggatgaactgctgagataatgatttgacggcataggtttaaggaggaaatacataatgaaaaaaggacgcttgattgcgtttttcctgatcgtattattgatcggcacagggctggggtattttacaaaaccggctgccaataatattacgttaggattggatttacgcggcgggtttgaagttctgtacgatgtgcagcccgtcaaaaaaggcgataaaatcacaaaagacgtgctcgtcagcacggtgcaggcgctgaaccgccgggctaacgttctcggcgtaagcgagccgaacattcagattgaaggaaataaccgcatacgcgttcagctggcgggcgtcacgaatcagaacagggcgcgcgaaattctgtcaacggaagcgcagctctcgttcagggatacgaatgataaagagctgttaaacggctctgatctcgtggaaaacggcgcgaagcaaacctttgatccgacgacgaacgaaccgattgtcagcgttaagctgaaggatgcggataagttcggagaagtgacgaaaaaagtcaagaaaatggcccctaataatcagcttgtgatctggcttgattaccaaaagggcgattcatttaaaaaagaagtcggcaaaaaacatccgaaatatgtatccgctccgaatgtgagccaggaattaaacacgaaggatgtcacgattgaaggtcagttcaccgttcaaaaagcgaaggacttggccaatattttaaacgcgggtgcgctgcctgtgaaactgaccgaaaaatactctacttcagtaggggcgcaattcggacagcaggctttgcatgatacggtagaggccggcatcatcggtattgcaattgttttcttatttatgctgctttattacagactgcctggactcatagcggtcattacgctttctgtatacgtgtatattacgcttcaagtgtttgactggatgcaggcggtgctgacgcttccgggtattgcggcgctcattttgggtgtcgggatggcggttgacgccaacatcatcacctatgaacggataaaagaagaactgaaactcggcaaatccgtccgctcagctttccgttcagggaacagacggtcatttgcgacgatctttgatgcgaacatcacaacgatcatcgcagcggtcgtgctctttattttcgggacaagctctgtaaaagggtttgcgacgatgctgattttgtcaatactgacaagctttattacagctgtcttcctttcaagattcctgctcgcccttcttgtggaaagcagatggcttgaccggaaaaaaagctggttcggcgtcaagaaaaaacatattatggacattcaaaaaacagatgaaaatactgaaccgcatacggcattccagaaatgggatttcacgagcaaacgaaaatatttctttattttctcaagcgctgtaaccattgcgggaattatcatcttactggtctttaaactcaacctgggaatcgattttgcaagcggtgcgcggattgatgtgcagagcaatcatgcattgacggcgcagcaggttgaaaaagactttgactctctcggcatggatccggaaaacatcgtgctctcgggtaaagagaaccatgttgccgcggcccgttttgtcggagagccatctaaagaaaaaatcgctgaaatcaaaacgtactttaaggacaaatacggatctgaaccgaacgtcagcacggtatcgccgacagtcggaaaagaactggcccgtaatgctttatatgccgtggcaattgcatcaatcggcatcattatttacgtgtcaatccgtttcgagtacagaatggcaatcgccgcgattgtatccctgctgtatgacgctttctttatcgtcgcgtttttcagcattacaaggctggaggttgacgtaacctttatcgccgctattctcaccataatcggttactcgataaatgatacgatcgttacatttgaccggatacgcgagcagatgaaaaaacgcaagccgaagtcatttgccgatctggaacatatcgtgaatctgagcttgcagcaaacctttacacgttcgatcaatacggtcttgaccgttgtgattgtggtcgtcgtgctgctcattttgggctcatcgtcaattacaaacttctccgtcgctttattggtcggtttattgacgggcgtttattcctctctttacatcgccgcgcagctgtggcttgtatggaaaggaaaagaatttaaagggaaaaaatcaatcgaagagtaaaaggaaacaggctgtcttccggaaggcagcctgttttttttaggccgcattgaacttaaaacctgcatttgctataatgacatacgcttacataatcaatcatcattgtaaaaacatgtaggggggttcttatgaacgttcgtgagtcggagcttccgggcatcggccagaaagtagaagtcattacgaaaaatcacgataaaatcagtattattcttcatgatgacggcagaaaagagctctattacttcgatgagaatgattatgacgaatgcttggcatctgttgaatttaacgacgaagaggcgaggcagatttccgctattttaggcgggatgacgtataagccgaaagcgctggaatctgtggaagtcgcgcttgatgacctcgtcattgagtggtttaaagccgaatctcatgcaccggctgtcagccgcacaatcggagatttggagatcaagaaacattacaacgtccagattattgcgatcgtgaagaaaaaccggcaaaaacagctgagccccggcattgataccgtaattgaagaaggggacaccctcgttatatcgggagaaagaagcggactgaaaaagctggtccgcgagcaattaacggcccggatttcctgagaccggggtttactcccgggaaaatgggggaaaagataagaatcaataattgggggcagacgcatgaataaacaatggactattatattcgctttactatttactctgattgtcgccatctttgctgtcattaacgtgcgggcggttgaggttgattatctgttcggaaccgctgaatggccgctgattttagtcattttaggctctgtgttaatgggagcgctgatcgtgttttcagccggtatatttcaagtgatgaaattgaagcgcgaaattaaaatgctgcggaaagaaaacagatccgcaggtgaattgacggctgattcggacggcaaaaaaacagccgcgccgccggaagaaatgcttgaagagaaaaaaggatcagaataacatttgaaacccctcagtccgctctagtataatagggtggttgaggggtgaatttatgttagcgtcaaaaatgcgctgggaaatccagcagccggatcaggaaaaagtcaaatcactcacagaacaattggacataacacctcttgtggcatcactgcttgtaaaaagaggttttgatactgccgaaagcgcaaggctgtttttacatacaaaggatgcagacttttatgacccgtatgaattaaagggaatgcgggaagcagttgatcggataaaactggcggtttctcaaggggaaccgattatgatttacggagattacgatgcagacggcgttacaagcacgtcagtgatgctgacggcactcagacagctgtcggcggacgttgacttttatattcccgaccgttttacagaaggctacggcccgaatgaacaagctttccgttccataaaagagcggggattttcgctgatcattacagtggatacgggaatcgccgccgtccatgaagctgaagtcgcaaaagagctgggcttagacgtcattattaccgaccaccatgagccgggacccgagcttcctgacgtatttgcgatcatccacccgaagcagccgggatgcggctatccgtttaaagaattggccggcgtcggtgtggcgtttaagcttgcccacgcgcttacgggttctttaccggaagctatgctggacttggcggcaatcggtacggttgcagatctggtgcctcttcatgatgaaaacagattaattgcgtcactcggaattgaaaggcttcgtacgacaaatcggccgggcctcaaagctctgattaaactttccggcggagatatcggacaagctgatgaggaaacgatcggatttcaggtcgcaccgaggctcaatgccgtcggaagaatagaacaggccgatcctgccgtacacctgctgatgactgaagatcagtttgaagcggaggaactggcttcggatattgaccggctgaataaagagcggcagaaaatggtgaaaaccatgaccgaagaggctgttgaaatggttcagcagcaaggcggaaacccgtctgccattgtagtggcaaaagccggctggaatccgggcgtcgtcggtattgtcgcatcgaagctggctgaacgtttttaccggcccgctgttgtgctcgggatagatgaggagcagggaatcgccaaagggtcggcgcgaagcatcagaggcttcaacctttttacgagcctttcacagtgcagagacattcttcctcatttcggcgggcatccgatggcggccggaatgacgctgaaggctgaagatgtggcggaattaagagacaggctgaatcaaatggctgaagaaacccttacggaagaggattttattcccgttcaggaggttgatcttgtctgcggcgttgaagacataaccgttgaaagcattacagaattgaatatgctgtcgccgttcggcatgcttaaccctaaaccgcatgtgatggtgaaaaatgccgtgcttgatgatgtgcgcctgatcggagcgaataaaaaccacgtgaaaatgacggtgaaaaatgattccgccgtccttgactgcgtcggctttaacaaaggagagctggaagccggagttgttcccggatcaacgatttccattgtcggcgagatgtccattaatgaatggaacaacagaaagaagccccagctgatgattaaagatgctgcggtgccggaatggcagctttttgatatccggggcaagcggacgtgggaagatacggtcaccgcgctgccgaaggagaaacgggtgctcatcagctttaacgaaaaaaccgctcagaagctccgtgaaaaagagctgacgggcgagcttgccgagatcacttcggaatccgaggcggaagctctccagcttgacggaaaatatgccgtttttctggatgtgccgccgtcagcggatcgcctgcagcatttgcttgacggaaagaagccggaacgggtttattttgtttttatcaatcatgaagaacatttcctgtcctcatttccatcgcggaatgatttcaagtggttttacgcatttctcttgaaaaggggcgcttttgacttcggcaagcatggttcagagcttgcgagacacagaggatggtcaattgacacaatcaatttcatgacaaaggtgttttttgatctcggttttgttaaaatagaagatggtgtgctgtctgtcgtgagcggtgcgaaaaaacgcgacctggcagattcgcaaacctatcaggtaaaacagcagctgatggaattagaccagaagctcaattattccgcagcccatgagctgaaggaatggctgaataagctgatgaaccaaggttcagaggcttatgaaagtacgaggaggacatagaacagatggatcttaaaaaatacgtaacaattgtgcccgattacccgaaagaaggcgtacaatttaaagatattacgacattaatggacaaaggcgacgtataccgttacgccactgaccaaattgttgaatatgcaaaagaaaaagaaattgatttagttgtcgggcctgaagcgcgcggctttattatcggctgtccggttgcatacgcactcggagtcggctttgcgccggttcggaaagaaggaaaacttccgcgtgaggtcattaaagtcgattacggtttggagtacggaaaagacgtactgacgattcataaagatgcgatcctgccgggacagcgtgtgctgattactgatgacttgcttgcaacaggcggcacgatcgaagcaacgattaagctagtcgaagaactgggcggcgtcgtagccggtattgcgttcttaatcgagctttcttaccttgacggcagagacaagcttgacgattatgatattttaacattaatgaaatattaaccgcatatggaaaaaagcactcgtgtcagggtgcttttttcctattatttcatcatcctgacagattctttaggtgttttgaacttctgccctttacatctctcgtttttttcttgataataaactaatacagtttacatttaaaaaaggtgattccatggcgaacgaacaagtattgactgccgagcaagtaatagataaagcgcgcacttatctgccggaggagcagattgcgtttgttgagaaagcttacctgtatgcgcaaaacgcgcatcgcgaacagtaccgcaaatcaggtgagccgtacatcattcatccgattcaggtggcggggatcctcgtcgatctggaaatggacccttccacaattgcgggcggatttctgcatgatgtggtggaggacacggatgtcaccctcgacgacctgaaggaagcattttctgaagaagtggcgatgcttgtcgacggcgtgacgaagctcggtaaaattaagtataaatctcaagaggagcagcaggcggaaaaccatcgaaaaatgtttgtcgctatggctcaggatatcagagtcatattgatcaagctggcggatcgccttcacaatatgcggacgttaaagcatcttccgcaggaaaagcagcggagaatttcaaatgagacgctggagattttcgctccgctggcccatcggctcgggatttctaagatcaaatgggagctggaagacaccgctctccgttatttgaatcctcagcaatattacagaatcgtcaacctcatgaagaaaaagcgcgcggaacgcgaactttatgtcgaagaggttgtcaatgaagtgaaaaaacgcgttgaagaagtgaatattaaagcggacttttcaggacgtccgaagcacatctacagcatttaccgcaagatggcgctgcaaaataaacagttcaatgaaatatatgatctgctcgccgtccgtattcttgtcggaagcattaaagactgctacgccgtactcggcattattcatacgtgctggaagccgatgcctggcagattcaaagattatattgcgatgcctaagccgaatatgtatcagtctctgcatacgaccgtaatcgggcctaaaggcgatccgctggaagtgcagatcagaacgtttgagatgcatgagatcgctgaatacggggtggccgcacactgggcttataaagaaggcaaggctgcaaacgaagaagcgacatttgagaaaaaactgtcctggttccgtgaaattttggaattccaaaacgagtctacggatgcggaagaatttatggaatcgctgaaaatcgatctgttttctgacatggtatacgtatttacgccaaaaggcgatgtcattgaactgccgtcaggctctgtgccgattgatttttcctacaggatccactcagagatcggcaacaaaacaatcggggcgaaagtgaacggaaaaatggtgacgcttgaccataagctccggacgggcgacatcgtcgagattctgacgtccaagcattcttacggtccgagccaagactgggtcaaactggcgcagacgtcccaggcgaaacacaaaatacgccaattctttaagaaacagcgccgtgaagaaaatgtcgaaaaaggccgtgagcttgtcgagaaagaaattaaaaatcttgattttgaagtgaaagatgttttaacgctcgaaaatcttcaaaaagttgccgacaagttcaatttctcaaatgaagaggatatgtacgcggcggtcggatataacggcattaccgctcttcaggtggccaacaggctcaccgaaaaagaacggaagctgcgtgaccaggaagagcaggaaaaaatcgttcaggaagtcacttccgagccgaaacattatcctcaagggagaaaacgggaagcgggtgtgcgcgtaaaaggcattgacaaccttctcgtccgcttgtcgaaatgctgcaacccggtgccgggcgaccatatcgtcggttttattacaaaagggcgcggtgtatccgttcaccgggatgactgtccgaacgtcaaaacgaatgaagcgcaggaacgtctgattcccgttgaatgggagcatgaatcacaggttcaaagacgcaaagaatataacgttgagattgagattttggggtatgaccgtctcgggcttttaaatgaggtgctccaagccgtaaatgaaacgaaaaccaacatctcctctgtctccggcaaatccgaccgcaataaagtcgctacgattcatatggcgatttttattcaaaacattaaccatctgcacaaagtggtcgagcggattaagcagatcagagacatctattcagtccggcgggtaatgaactaaaaggagcttgctatgaaattagttgttcagcgtgtaacagaagcgagtgtgacggttgacggcgctgtcgccggccggatcggacccggtattatggcgcttgtcggcatcactcatgaagatacagaagaagatgccgcttacttggcggataaaatcgtgaatcttcggatatttgatgatgaaagcggcaagatgaatttatcgcttttggatacgggcggggagattttatccgtttcccagtttacgctttacggcgaaacaaagaaagggagacgcccgaattttatgaatgcggctaaaccggatcaggctgtgctcctttatgaaaagtggaacgaactccttcgggaaaaaggagtcaaagtgaaaaccggaatattcggagccatgatggatgttcagctgacgaattccgggccgattacattgattatggattctaaacaataaaaaagctgccgttcggcagcttttttttatgattgaaaataatgttccaatccgctttcaattccgtctgtcactttttcctgataagagccgctatgtatgattgtttcttcttgcggttgactgagatagccgagctcatacagcatggcaggccgtttattttccctcaggacgtaataatcgccaaacagaacgccgcgatcaggaataggggaacgcttcactacttcagaatggacgtctgaggcaagctggcggtccttagacggactgtaataataagccgtgcttccccgcgttgacgtatcggcataactgtcatagtgaatgctgataaaggcatccgcattccggtaatgagaggttgaaaccctggcctgcaggctgataaatgtatcatcctgtctggtgatatacacgtttgcaccggccgctctcaattttccggctaacagcttagcggttttaatcgttacgtttttttcaaactttccggagtagccgatcgttccgctgtcttttcctccgtgtccgggatcaacgacgatcgttttgtttttaagtgagccgctgccgcctgacgtgttgggagaaggtgcttcgcctgtttcctcaccgctttttgacgtttgtacgacccagtctgccacatatgcggtttgtccgttttcaagccggacttcataccatttgccgcttgagccgacaatcgggtaggctgcgcctttatctgctctttttacgatagaagcggaagtcgaggccgagctccttaagttggtgccgccgtaaacaatatacgcttttttcgaggagcctgagcccgcagaaccgtctcctgagccggatgcgctgcccgatgagtcagaatcctttatgatgtagtggcttgctgcccagcctttttgaccgtttgcttcaattttcagccagccgtggtcttcacttaagatggaaacctttgttccgcgtgataatttagtcataatcgctgaatcatgtgacgctgcacttctgacattcaatgaagaaacgccgaccgttccgctttttgacccgcttcgggccgaagttgctttcgtatccgatccgccgctgtccgcggtgacgtattcggaagaaacccacccggttgtgccttgataagaaatgttcacccatccgctgttcttgtccagcacggatgcatgcgcgccttgcggaagtttgccgatgacttcatacgatgtccccgggccttttctgatgcggaggtcaggatcagtggaagtgaccgttccgcttgttgcggatgaattgtctgctcccccggctgtttttgatatcagccaggaaacgacccatccggttttaccggggctcagctgaagctgtacccagtctccctcttctttaacgatcgggtatctttcccctttttttacttcagcctttattccgtagctcaggccgggaccgcctctgacattgatcttgtctgtcgcgatgaccgcttctccctctgcggcgattgcggtgtgaaatgacggaagaagcgctgtgatgatgacgccgcataaaataagagcaagagttctcttcttcatggctgtcctcctttctgaactaactaaaatacattcttgtataatatcgtattttccttgctgaatgttaaataaaaataaaatggtttgtttatactagtcataaatacagcgaaaaggtgtgcaaatcatgaaatatcaaccaaaaatggggcgcgcgctgcacgatgcggaaggaaatctgcatttcagtgatcagagcgatagagaaaaggcgggttttcttgaagagacggcgacggagttcggtctcttatcgaaagaagcggtcgcaaggaaaaacagacggaataaaacttgacaggggagtgcaatcccattattataatagaaattgatgtacataactcatgataacgattttgaaccgataatggagaagagtaggtcagaatgcatggaaaagagaggaaccgtcccgggctgaaagcggatccgcactgcatctttctcgaaacaacactccggaggttccctgctgaacgcttttgcaagtcattaggcagcggacgtgaacctgcgttaaaggtcagagcggggatgcttcggcattccaactagggtggcaccacgggtataactctcgtccctactatacatgtatagtaggagcgggagtttttttatttgaagaaagacattaaggaggcctgtaacatggcatatcacattccaagaggcacacaggacatactgccgggtgaatcagacagatggcagttcgtcgaacaaattatgagggagacgtgccgcacttatcaatataaagaaatccgcacgccgatcttcgaacatacggaattattcgcaagaggcgtcggtgagtctacagatatcgtgcagaaagaaatgtacacgtttgaagaccgcaaagggagaagcttgacgcttcggccggaaggaacagccgccgcagtccgcgcgttcaatgaaaataaattatttgcgaacccggtgcagccgacgaagctttattatgtcggaccgatgttccgttacgaacgtccgcagacagggcgtttccgccaattttatcaattcggaattgaagcgatcggctccaaagatccggccgtggatgcagaagtcattgcgcttgcgatgagtatttaccgtaaagccggtttgaaacatgtcaagcttgtgctgaacagccttggtgaccaggagagccgcaaatcctaccgggaagcgctcgtcaaacattttgaaccgcgcatcggagaattttgctcagactgccaatcgcgtctgcacacaaacccgctcagaattcttgactgcaagaaagacagagagcatgaactgatgaaaacggctccgtccattcttgattacttaaatgaagaatcagccgcttattttgagaaagtaaaacaatacttaaacggtctcggcatcccgttcgaaatagatccgaaccttgtcagagggcttgattattataaccataccgcttttgaaattatgagcaatgccgaaggattcggagcgattacaacccttgccggcgggggccgctatgacgggcttgttgaacagatcggcggacctgaagcgccgggtatcggatttgcgatgagcatcgaacgactgctggcagccattgacgctgagaaaacagaccttcccgtcaatcaggggatcgactgctacatcgtgacgctcggagaaaaagcgaaggattattccgtttccctcgtgtacaaactgagagaagcgggcatctcaagtgaaatcgattatgaaaataaaaagatgaagggccaattcaaaacggctgaccgtctcggcgcacgttttattgcgattttaggggaagatgagcttgcccaaaataaaatcaatgtaaaagatgcggaaacaggagagcagcgtgaagtggtgttagacgagctgatacaagtgttaaaggcagatcaaaagcagtgaaggagaggaacgctatgtttggaagaacatattattgtggcgagataactgaaaaagcgattggcgaaaccgtcaaactgaaagggtgggtgcagaagcggcgcgatctcggcggcttgattttcattgatttgcgtgaccgctcgggtattgtgcaagtcgtgttcaaccctgacgtatcgaaggaagcccttgccgcagcggaagcaatcagaaacgaatatgtgcttgatatcgaaggcacggtttctgcccgtgaagaaggcacggtgaatcccaacctgaaaaccggtaaaattgaaatcaaagctgaagcggtgacggtgctcagtacggcgaaaacgcctccgtttccgatcagtgaccaggcggctgaggtttctgaagacgtccggttaaaacaccgctatttggatttgcgccgcccggcgatgtttcaaacattgcaaatgcggcatcaagtcacaaaatccatccgccatttcttggatgaaaacggatttcttgatattgaaacaccgattttaacaaaaagttctcccgaaggcgcccgtgattacttagtgccgagccgggtgcatgaaggggaattttacgcccttccgcaatcgccgcagatttttaaacagcttctgatggtgtcgggctttgaacggtattatcaagtggcccgctgcttccgcgatgaagacttgcgtgccgaccgccagccggaatttacgcagattgatattgaaatgtcctttatgagtcaagaggacatcatggctctggcggaagagatgatggcgaaagtcatgctcgaaacaaaaggcgttgaagtatcgcttccgcttccgcgaatgacatatgaagaagcgatgaacagctacggttccgacaaacccgatacccgcttcggcatgctgctgacggacgtgtcagacatagtgagagatactgaatttaaggtgttctcatcagccgtggcaaacggcggcgttgtaaaagcgatcaatgtcaaaggcgctgccggcgactattccagaaaagatatcgatgcgctcggcgtttttgccggaaattacggcgcgaaaggtctcgcttgggtgaaagtagaagctgacggcgtaaaaggcccgattgcgaaattctttgatgaagagaagcaggcaaaactggctgaagcgcttgatgcttctgaaggcgatctgctcctgttcggcgctgataagtttgaggttgtggctcaatccctcggcgcgcttcgcttaaagctcggcaaagaacgcggcctgattgacgaaagcctcttcaacttcctgtgggttgtggactggccgttattggagcatgacgaggaagaaggccgtttctatgcggctcaccatccgtttacaatgcctgtccgtgaagatcttgacctgattgaaacggcgcctgaagatatgaaagcgcaggcttacgacctcgtcttaaacggctatgaactcggcggaggctcaatccgtatttttgaaaaagacgttcaggaaaaaatgttcgggcttctcggctttacaaaagaagaagcggagcaggagttcggataccttcttgaagcctttgaatacggcgcccctccgcacggcggaatcgcgctcggcttagaccggttggttatgcttcttgcaggccgcactaacttaagagatacgatcgctttcccgaaaacggcaagcgcaagctgccttcttacggaagcgcccggcgaagtgagcgacgcccagcttgaagaacttcacctttctgtcaaaagaaaagtgaaacagtaaagatcggcagtttgtttcttgaaaatcaaaatctgctgtgatatgattttgacaagttaaataaagtcctgatgtgttagttgtacacctagttttgaccgaacatttttttgatttgggagcccgcatttttaaatggcgtacatgcctcttttcattcgctaaagaggacttacaagatttaaaaaagggcacccacctgctgagagcgggttcaaaacgaaggaaagctgcaacggcacaattgggactttattttttgtgcgctaaaaccagcggctttttgacaagccgagtttataaaaccagaatgtggagtgaggttcttgttacatcagttttccagaaatgagctagcgattggaaaagaagggctggacacgttaaaaaacagcacggtggccgttctcggcgtcggcggagtcggttcattcgcagccgaagcattggcgaggtccggagtggggcggatcgtgcttgtcgataaagatgatgttgatattacaaatgtaaaccgccagctgcatgcgctcttgtcgacggtgggacagccgaaaacagaattgatgaaagagcggatcgctgatattaatccggattgtgacgtcgtcgccttaaaaatgttttatacagaagagacgtatgagcagttctttgagtatccgctcgattacgtcattgacgcgtcggatacgattcattataaaattcatctgatgaaagaatgtctgaaacggaatgttccgctgatttcaagcatgggagcggcgaataaaacagacccgacacgctttcagattgctgatatttcaaaaacccatactgatccgattgccaaagtcgtccgcacaaggcttcgtaaagagggcattaaaaaaggcgtacaggtcattttttctgatgaaagcccgatcgtcatccgtgaagacgtcagaaaagaagtcgggaatgatgaagcgaaaatccgcaaagcgcaaatgccgccgtcttccaacgcctgggttccgtcagtggccggtctgattatgggcggacatgttgtcatggagctcttaaaggacatcgacattaaacgggttaaagataagtaaaaagaaaaacagccttcttcaggaaaggctgtttttttatttgaatccgccgtttacacgaaagatcttgtccggttattttttctgcttcatcagtttttcatacacttgctttatggcggcttcaaatttccccgtttgtttcggtttatagtattgcttgttttttaacggatcgggcaaatattgctgttcgacccatccgttctcgaaatcgtggggatattgatagccgatcccgcgtccgagctcttgggcccctttatagtgggcgtcttttaaatgtttcggcacatcgccgattttacccgtcctgatgtctttgagcgcctcatcaacggctgaaatggcggagtttgatttcggcgagaggcataattcgattaccgcattggccagcggaattctcgcttccggaaagccgatccgttctgcggtctgaatcgcgctcagcacccgggggcctgcctgcgggcttgcgaggccgatatcttcataggcgatcacgagaagccttcttgatatgctttcaaggtctccggcttcgatcagacgggccagataatgaagggcggcgtttgcgtccgagccccggatcgatttttggaacgcggataagacgtcataatgcgcatcgccgtttttatcatgggtatagctttttttctgcagacattcttccgccgtttcccgtgtaatccggatcgtcccgtcgcttgattcctttgtggagagcacggcaagctccagtgcgttcaaagcggagcggacgtctcctccgcacccttgtgcgaaatgatccatcgcgtcgtcgtccaccgaaacgctgtaggaaccgagtccccggtgttcatctgtgagcgctcttttcaatgcctgcctgatcagatcgggtgttaacggttcaagctcaaatatctgggtccggcttctgatggccgggttaatggcatgataagggttggcggtcgtcgcgccgattaaaataatcatgccgttttctaaatagggcagcagaaaatcctgctttcccttatcaagtctgtgcacttcatcaaggattaaaatgacctggcctgacattttcgcttcctgtacgacaatctccatgtcttttttattatgaatgacggcattcaatttcctgaatgcgatgcttgtcgatcctgcgatcgctgtggcgatggacgtttttccgatgcccggcggtccgtacaggatcatggatgataagtgcttcgcacgcaccattctgccgatgattttatcttctttgaccaaatgttcctgaccgataatgtcttcgatattggcaggccgcatccgatacgccaatggtttcatgaacatctctccttacatatacagggtaacggaaaacggacgattagaaaagcgaattgcggcgggccccgtgtttcaatgaaaattaggataagttatgttataataacagttggtctataagatactaaacagattattcatatccatttacttgtataaattaacaattagaattgactggggtgttcatattgaaaatatcgacaaagggaagatacgggctcaccattatgattgaattggcgaaaaagcacggagacggtccgacgtcgctcaaaagcatcgcccaaacaaacagcctttctgagcattacttggaacagcttgtatcaccgctcagaaacgccggactcgtaaaaagcatcagaggcgcttacgggggttacgtgctcgggggccagcctgaagagataacggccggagatattatcagagtgctggaagggccgatcagcccggtagaagtgcttgaggatgaagagcctgccaagcgggagttatggatccgcatccgcgacgctgtaaaagacgtgctggacagcacgacgttagaagaccttgcgagctacacggacggcgagcaggaagcttatatgttctatatttaaaccagaggtgtaaagacaatggaacggatttatttagatcatgccgcgacttcccccatggatgaacgtgtgctcgaagaaatgaagccccatttcttcggcagtttcggcaacccgtcaagcattcattcattcgggagagaatcccggaaatgggtcgatgaagcgagagcggacatcgcgcgcgaaatcagtgcgaaagaacaggaaattattttcacaagcggcggtacggaggctgataatttagccattttcggaacggctgccgcccggaagaatgaaggaaagcatatcattacgaccgctgttgagcatcatgctgtattgcacgcctgcgaaaagctggaagaagacggctttgaggtgacatacctcatgcccggcccttcaggacggatcagtgcaaatcaggtgaaagaagcgctccgtgatgatacaatccttgttaccgtcatgtatggcaataacgaagtcggaaccattcagccgattgacgaaatcggagagctgttaagcgggcatcaggcctattttcacacagatgccgtccaggcattcggttatatgccgattgatgtgaaaaaaagcagaattgacatgctgtctgtttccggtcacaagcttaacgggcctaaagggacaggctttttatatgtaaatcaagaggtgaagctgtcaccgattcttcttgggggagagcaggaacgaaagcgccgcgcggggacggaaaatgtaccgggcatcgccggcttaaaagaagcggtcgtcctttcaaaccgtgagagggaagagaaaacagcgaagtataaggagtttaagaacatcatcatgagcacgctggaagaagccggcgttacagcggaggtgaacggagatgccgagaaatgcctgcctcatattttaaacctttactttcccggtgtgccggtggaagcgctgctggtcaatcttgacatggaaggcattgccgtatccagcggatctgcttgtacagcgggatccgttcttccgtcccatgtgcttacggccatgttcggaagtgagagcggcaggctgacttcgtcaatccgcctcagcttcggcctcggcaatacggcggaacaaatcgaaacagccgccgaaaagcttgccgccgtcgttaaacggcttgcttaaaacggcggacttacgtttttaatggagtgaatgcaaatggaaaaacggccggaggatacaagagtcgtagtcggcatgtccggcggcgtggactcttccgtggcggcccttctgctgaaggagcagggctacgatgtaatcggaatctttatgaaaaactgggatgatacggacgaaaacggtttttgcacggcgacggaagattatgaagacgtcatccgggtctgcaaccagatcggaattccgtattatgccgtcaattttgagaagcaatattgggaaaaggtatttcaatatttccttgatgaatataaagccggaagaacccccaatccggatgtcatgtgcaataaagaaattaagtttaaggctttcttggatcatgctctgtcactcggcgcggattatcttgcgacgggccattacgcccgcgtggacagaagcgcaggtacagtgcgcatgctccgcggtctggatgaaaacaaggaccagacttattttctgaatcagctcaatcaggaacagctcagtaaagtcatgttcccgatcggtgatctgcaaaaaagccgcgtgcgggaaattgccaaagaagcagaacttgcgacagctgcgaaaaaagacagcacgggaatctgctttatcggcgaacgcaacttcaaaacgtttctcagccaatatctccccgctcagccgggcgatatgatgacaatggacggagaaataaaagggcgtcatgacggtctgatgtattatacaatcggacagcgccacggtcttggaatcggcggaagcggcgagccgtggttcgccgtcggtaaagatcttgaaaaaaacattctgtatgttgatcaaggattccataatccgcttctgtattccgataagatcacggcgacaaatgtcagctggacgcgtcccggtctgatggacggcggcgaaatgacatgcacggcgaaattccgctaccgtcaggaagatcacaaagtaacggtgaaaatgacgggtgatgatgaagcggaaatcatttttgacgggcaggtacgcgccgttacgccgggacaagccgtcgttttttatgacggagaagagtgcctcggcggcggaacgatagatgacgtttataaagacggaacaaaactgtggtacgtataacacatgtaaaaaacctcaactcgcatgttggggttttttagcgaaaggaagttaaaaatggattataataaaatcgggattgacgccatgcaggagggcgattttgaaaaagcggcagaggcttttacgaaagcgattgaggaaaacggccaagacccggtgccgtacatcaacttcgcaaatctgctttcttctgtgaacgaactcgaacgggcgcttgcattctataacagagcgcttgaattggacaattcggcggcagccgcttattacggtgcgggaaacgtatatgtgatgaaagaatcgttttccgaagcgaaggatatgtttgaaaaagcgcttcgttccggaatggaaaacggagatttgttttatatgctggggaccgttctcgttaaattagagcggccgaagcttgcactgccgtatttgcagcgtgccgttgaattaaacgaaaatgacacggaagcgcgcttccagttcggaatgtgtctcgcaaatgaagaaatgctggatgaagctcttgcgcagtttgagacggtgatcgagcaggatccaggccacgcggacgcattttataatgccggggtcgcttacgcgtacaaagaaaatcgtgaaaaggcgcttgagatgctggaaggcgcaatcggcatacagcctgatcatatgcttgcgcttcatgcgaaacagcttatcacccagtcataacaaaaggagggaaggctcgtggatcagctgaacatcgaagaacagccgtatgtaaaaggcgtcattcatacggtcatttatcataatgacaccaacctgtatacagtgctgaaagtcaaggttgcagaaacgtctgaggcgatcgaagacaaggtcgtatccgtaacgggctacttccctctgctgcaagaagatgagacctacacattttacggaaaaactgccacgcatcctaagttcggcctgcaatttcaggctgaacactttaaaaaagaaattccgaccacaaaagaaggaatcattcactatttatcaagtgatctgtttgaaggaatcggaaaaaaaacggcggaagaaatcgtcaaaaagcttggagacggcgcgctcaataaaattctgtcggatgcgtcggtgctttatgatgtgccgaaaatgtcgaaaaagaaagcggataagcttgccggagagctgcagcggcatcagggtcttgagcagattatgatctctctgaaccaatacggtttcgggccccagctatccatgaaaatatatcaggcctacgaaacggaaaccttggagaaaattcaggaaaatccttatcagcttgtaaaagacgttgagggcatcggctttgtgaaagctgacgagctgggcggaaaaatgggtctgtcaggaaaccacccggagcggatcaaagcggcaatcttatatacgattgaatcgacctgtctttcagagggccatacgtacatagagacaaagcagctgattatcaatacgcaaacgctcctgaatcagtcagctgaaggcggccgcgtcacggaaatggatgcggctgacggcatcatcgccctcggggagagtaaggatatcgtcatcgaaggagagcgctgctattttccgtccttgttttacgcggaacaaaacgtcgcaaaacgcgtgctcgacattgcggctcagacggagtatgccgatcaatttcctgaatcggaatttctgcttgcactcggtgaactggaagaacggatgaatgttcaatacgcaccaagccaaaaggatgccattcaaaaagcgctgtcttcaccgatgcttttactgaccgggggacctggaacggggaaaacgaccgttattaaaggaatcgtggaattatacagtgaactgcacggcgtatcccttgaccccggtgattataaaaaagacgaggcgtttccggtgctgcttgccgcgccgaccggaagagccgcaaaacggatgagcgaatctacgggtctgccggctgttacgattcacaggctgctcggctggaatggcgctgaaggctttacctacaacgaagatcagccgattgaagggaaactgatcattatagacgaagcgagtatgcttgatatctggctcgccagccatttgtttaaggcgcttcctaagcacattcagctcattgttgtcggtgatgaagaccagcttccttcagtaggaccggggcaggtgctcagagatcttttggcttctgaagtgctgccgaccgtgcgcctgacagatatttaccgtcaggctgaaggatcatccattgtggaacttgcccatgatatgaaaaaaggactgcttccaaaggggctgaccgcgccgacaaaggaccgctcatttatccgctgtaattcttcacagattaaagaagtcgtggatcaggtcgtctcgaacgcgttaaaaaaggggtatacctccagagatattcaagtgcttgccccgatgtacaggggaaaagcgggaattaacgagctgaatatgcttcttcaggacatcatgaatccgccgaaagaaaaaaggcgggagctgaaattcggagatgtcgtctacaggacgggcgataaaatattgcagcttgtcaaccagccggaaaacaatgtgtttaacggcgatatcggcgaaatcgtgtccattttttatgccaaagaaaatacggaaaaagaagacatggtcgtcgtctcgtttgacggcaacgaaatcacctttacgaaaaaggatttcagccagtttacccacgcttactgctgttccattcataagtcgcaggggagcgaattcccgattgtcgtcctgcctgtcgtcaaaggctactatcgaatgctcaggagaaatctgctttataccgccattacaagagcgaaaaaattcctgattctttgcggagaagaagaagcgcttgaatggggcgttaaaaacaatgatgccaccgtcagacagacgtcgcttaaaaacaggctcacagagcagactgaagagatggatgcagaactggccgccctgcaaaaagagctgccgttcagtgtatatgatgcgaacatcggaatggaaggcatcacgccttttgactttatggaagaaaaagcgtaaataaaacccggcacatgttcatgcgccgggttttcgcctgtggaagtcatttcaaagtatgctgcccggcttcttggcaaaacctatacgtgttcaacaaaaggtggttgatcacactttgagaacatgccatgcagctgaaggacgaacagtatatgacgaaaacaccgggcgcagtctcgggatgatatcggatgtatgtttctctctggacggccggtttctcggtttcgtgctggagcagaaacgcctgtttcacaaccgtcatctttttttaggggcaagtgatataaaagagatggatcaagaagccgtagctgccggtcatgctcatttgcagcctttgccgaagagctgtttcacctttgaacagattaaaatgcagccggtgaaatcgcctgatggtgaaatgttcggtttgctggaagatgtatacttttgtttggacaggggcataatcgtagcatatgaactctcggacggcttcttttcagatctggctggcagacgccaagtgcgccgcgccgccgatatgcttattgaagcggggaaagaaggcatcgtcctgaacggataagaggtgtagtctgtgcttgtatgtccgaactgcaaaagtaaagatatcggcaaaatcggcgtaaaccaatactattgctggggctgcttcattgagctgacggtggccaaaggcaaaattgcgacacatcaagtagaggaagacggcacgttaagcagtcttgatgatttgttttctgaagacgaacgcagtatcaatttttaaagttgaaaggagatacgcgcgatgggcagaacaatgacctctctgttggctttaggagctggagccgttatgtatcgtatggcttctcagtccgatatgctgaataaaaaaggtatgaaacggatgagaagacgagtcatgaaaatgttttaagcggaaaaaaggatacttctccggaagtatcctttttacgtttgtctcgcttccagccgtctggcagcgagagacaggctgtaattgaccgcgaaatacatcagggccgccagcagaaagatcgggaaaaaataccccccgtcagcgctttgtccgtttaaaatctgcgcgttatgaatcagttcgggcagagcgatgacgaccgcaagtgacgtatcctttaataaggagataaactggctcacaatcggaggaaccatacgccttatcgcctgcggcatgacgacgagaaaaagagtctgcgtgtacgtcagtcctgaagaacgcgccgcttcaatctgtcctttgtcaacggattgcaaaccgcttctgatgatttctgacagcatggccgattcaaaaatcgtcagcgccgtgatggcggccgcggtaatttccagtttgatcccgatttccggaagggcaaaaaacgtaaagaaaatgattaataacagcggcaggttgcggatggtttccacaatggccgctataatgcccgagacgataggaatgttcgcatagcgcaaagtgccggcggcaagcccgaacataaaactcaggacaatggagatcagcgcaacataaagtgtgaccaaaaagccgtcccataaaaacagcagatggtcaggtgtataggcgccgctaaaatccatgttattcactctccttctctaataactttttccgagacgtctttccaaatagtgaaccccgatgctgagcgggatcgttaatatcaaataaaaaagcgcgacgaaaatatagacatcaaacacgacaagagtgctcgaggacacgagatccgcctgatacatcaaatcgagtcccgccaccactccgagtattgatgagtttttgacaaggttgagaaattggtttccgagcgggggaatgacgatttttacggcctgaggaagaatgatatatctcatcgcctgactgtaggtgaagcctgacgatctggccgcttccatctgccctttggggacagtctgaattccggctctgatggcttctgcgataaaggcggacgtgtaaatcgtaagcgcaatcgttcccgcctgaaagccgtccagtctcagcccggcgttcggaagtccgaaataaaaaacgaatgtgatgaggagaagcgggatgttacggataaattccacatacgcagtgccgatccattgaaggggtttgaaagccgtgattctcatgactgcgatcagaacgcccagcgcaaagctgcctgccagcgcgatgaagctcgcaagcaatgtgtgcaggaaaccgtccatatacatatcgaagttttccgttaaaattgaaaagttcatctatgtcactccttataaaacggggatgagcatgcatgctcatcccgcggtccgtcctattttgccggttcttcttttatccattttttatagattttttcgtacctgccgtcggctttcatttttttcaaagaggcgttgatttctttgacaaggccggattggccttttttgacggcgattccgtaaggttcatcggtaaaggttttgcccgtcagctgatattgtttattttcatcggccatgccgtataaaatcgcattatcggttgtgagcgcatctccctgtccagctttaagcgcagtgaacgcttcggcgtaattttcaaattccagcactgaggcgtcaggcgctttttctctgatgttctgtgaggaagtggagccttttaccgccaatacttttgagccttttcccaggtcttcggtgcttttgatgctgcttccttttttgacgagcagggattgcccggcttcaaaataaacatctgagaaatcaacttcttttttccgctcatccgttatcgtcatcgtggcggtgatggcgtcgatatcgccgttttgcagcagcggaatcctcgtttttgacgtcacttctttaaattccgctttcttctcatcccccagaatatcttttgcgagctgttttgagatatcaatatcgaagccttcaatatcaccggagcttgggtttttcagcccgaataacctcgtatcggttttgacgccgaagatgattttgtctctgtctttaatagaggctaacgtgtcttttcccgttccttttgaatccccggacgtttctttccctccgcaggctgccagcataaagacggccagcagtgatatcaatccgaatgacaaccattttgttgcgcgtgacataagcgctcctccgtttcttttcagtgatttaaaatacggcttaagaataaacgcgccctctcttcacgggggctttcgtaaaattcagccggtgcagcttcttctaagatggatccgccgtcgataaacacgatgcggtccgccacttcttttgcgaatcccatttcatgtgtgacgactgccatggtcatgccttcctttgcgagtgttttcatgacatccagcacttccccgatcatttccggatcaagcgcggatgtgggttcatcaaacagcataatttcgggcttcatcgcaagccccctggcgatggcgacacgctgctgctggccgccggaaagctgtgaaggataagcgtccgctttgtccggtataccgacttttttcaaatagtataaggccgtttcctttgcttcttcttttgattgcttgagcactttgatcggtgcgagcatgatattttgcagaacggttttgtgcgggtacagatgaaaatgctgaaacaccatgccgatattccggcggacctgatttatatccgttttcttgtcacggatggagacgccgtttaccgttaaggcgcctccatcaactgtttccagctgattaatgcagcggagaagcgtgctttttcccgatcctgaaggtccgatgataacgacgacttccccttttttaatgtgcagattaatgtttttcagcacgtggaaatgtccgtagtgcttatttacatcctgaaatgaaatcatggccatcctccttaaaaaaacatgagtcatattgactggacagttttgaaatcctttaacacattacgatggttatacagacttttatgaatattatttagattatttcgtaatttctgataattattcccgtcaagaggtctgcgtcataaggcggagtttatgaaacgagaataattccggctttctgtcaaaagataaagcaagaggtgaaacgtcatgcttcaaaaaccgctgcagctcttactgtggacggctgtatgtctgctcgttttgttaacagtgtatgtcttttgcatgctcgatatgttatggtctcccatttggcttgttataaaatctctctttattcctatattcatcgcagtatttattgcttatcttttacttccgattactgaatggcttcatagaaaagggatgcctagaactttaagcctgcttctgatttattgcctgtttttcggcggaatcggctggggggtttataaaggggttcctgttttaattgaacagctgcaggatctgtctgagagcattcccggtcttgccgaaaactacaacagcatgctgaggcatctgcataatcacacggatcattggcctgacggcatgcaccatcggatggacaaaatgattcagcagacagaaacgtttcttgccggcacgattgaaagcacgatcagaagcatccgtttcgtgcttgattatatcctgatcgcggcgacgattccttttctcgtgttctatatggtgaaggatataggcgtcatgaaaaagacggtctggtatttgacgccgaagtcctggagaaaaagggggagtgaatttctgcgggatgtggacgactctctcggtgattacatccgcggtcagcttctcgtttgttttttgctcgggttaatagccggtgtttcattttggctgttcgggcttccttacccgctgattttgggccttgccatcgggattacgaatgtcatcccgtatttcggtccgtttattggcgctgtgccggcgctgctcctttcgctggcgatttcctccaaggctgtgatcatcgtaatcgtcacgatttttattcttcaatttatagaaggaaacattttgagcccgctcattgtcgggcgaagtctcagaatgcaccccgtcgtgatcatgcttgcgcttcttgccggaggagagctcgcgggcattcccggcatgattctcgctgttccggcggcagccgttttaaaagtgacggccattcactttttgcggatcaggacggaacattgacattcgggttctgcttgtctataatttcgagtagaatacatacgaatctcgagtgacggataagagtacgccgaagccctgtttaagagagaagctccgatacgctgagaggagcttcagcagaagatcggccgaagctaatcctgagtgcagttaaaggctgccgcaatcctgcgttacgggatgaaaggtgacaggcctttttcggcctgtaatcagggtggtaccgcgagacagctctcgtccctgtgtgaacgcatggtttgcatagggagagagcttttttgctgtcgcaaaagagaatttcgggtagtgataaggaggaatatagatgaaacacttaacttctgctgaagtgcgtcaaatgtttttagatttctttaaagaaaaaggccatgccgttgaaccgagcgcctcattggttccgcatgaagatccgtctttactgtggatcaacagcggcgttgcgacgctgaaaaagtactttgacggccgcgttgtgccggagaatccgagaattgtaaacgcgcaaaaatcaatccgcacaaatgatattgaaaatgtggggaaaacggcgcgccaccacacgttctttgagatgctcggaaacttttccatcggtgattattttaaagaagaagccatcacgtgggcatgggagtttttaacgagcgaaaagtggatcggctttgatccggagctgctgtctgtaacagttcaccctgaggatgaagaagcttatacgctatgggcggaaaaaatcggcgttccggaagaaagaatcatccgtctggaagggaacttctgggatatcggcgaaggcccgagcggaccgaatacggaaattttctatgaccgcggcgagaaatacggcaatgacccgtcagattctgaattgtatccgggcggcgaaaatgaccgctatcttgaagtatggaacctggtattctcagagttcaaccacaacccggacggcacgtacacaccgcttccgaagaaaaacattgatacgggcatggggcttgaacggatggtctccgtgattcaggacgtcccgacaaactttgacactgatttgtttatgccgattattgaagcaacagagcgcatttccggagatgcttacggaaaggacgcagtgaaggatacggcctttaaagtgatcgccgatcatatcagaacggtcgcatttgcggtaagcgacggagctctgccgtcaaatgaagggcgcgggtatgtactgagacgtctcttgcgccgggcggtgcgatacgcgaaaaccatcggtatcagccgtccgtttatgtacgagctggttccgactgttgcaggaattatggacgctttctatccggaggtgaaagaaaagcaagagtttatcgccaaagtcatcaaaacggaggaagagcgcttccacgaaacattaaacgaaggtctggccattttatctgacgtgataaagaaagagaaggaaaaaggcagcggcatcatctccggaaaagacgtattcaaactgtacgatacgtacggattcccggttgaattgacggaggaatacgcggaagatgaacaaatgaaggttgaccataaaggctttgaagccgaaatggaaaaacagcgtgaacgggcgagaaatgcgcgccaagatgtaggaagcatgcaggtgcagggcggcgcattgcgcgacattaccgcagaaagcacatttgtcggctacagtgccgtaaaagctgaagcgaaggtgatcgaacttcttcatgacgggcaattaatcagcgaggcgcatgaaggggataccgtccaaattcttcttgacaaaacgcctttctatgctgaaagcggcggacagatcggtgacagaggagtgctgagaagcgagcaggctgtcgtaaccattaaagacgtgaaaaaagctccgaacggccagcatgtacacgaaggcacggtggatagcggcacgattcaaaaaggcgcaagcgtgacggctgaagttgaagatcaaatgagaagcggtgtggtgaaaaaccatacagcaacccaccttctgcaccaggcgctgaaagacgttctcggcacacatgtcaaccaagcgggttcactcgttaccgaaaatcgtctgcgttttgacttctctcatttcggtcaagtgacgaaagaagaacttgaacgcattgaaggaatcgtcaacgaaaaaatctgggagagcattccggtagcgattgatttgaaaccgatcaatgaagcgaaagaaatgggcgcgatggccctgttcggcgagaaatacggcgatatcgtccgcgtcgtacaagtcggagattacagcctggagctttgcggcggatgccatgtcacgaatacggctgaaatcggcctgtttaaaatcgtatccgaatcagggatcggcgcaggtacgcgaagaatcgaagccgtaacaggaaaaggcgcttatcaggaaatgaacagccagctcagccttctgcagcacgctgcggatgagctgaaatcaaacgtaaaagacgtaccgaagcgaattcagtctcttcaagcggagctgaaggaagcgcaaagagaaaatgaatcattgctcagcaaacttggcaatgtggaagccggagccattctgtctaaagtaaaagacatcggcggcgtaaaagtgctggctgaaaaagtaaatgcgaaagacatgaaccaccttcgcactatggtggatgatctgaaagcgaagctcggttctgcggtcatcattctcggcgccgtgcaaaacgagaaagtcaacctttcagcaggcgtaacaaaagacctgattgaaaaaggccttcacgccggcaaaatggtcaaacaagcggctgaagtctgcggaggcggaggcggaggccgtccggacatggcgcaggccggcggaaagcagcctgaaaaattggaagaggcgctcgcatctgcggaagattggataaaatccgttttataatcctttcaactagtgtagaatgatgataagatgaggacctcaggctgaactttgcctgcgaatttgggaaagaggtgcaaaacggtgagctcgtttgataaaacgatgaaatttaatttctccgatgattctgctgaaacaaacgtcgaagaagtgctgattacggtatatgatgcgcttcaggaaaaggggtacaatcctatcaaccagattgtcggatacttgctgtctggagatcctgcatacattcctaggcatcgcgacgcccggaacttaattcgcaaactggaacgtgacgaattaatcgaggaattggtaaaatcctatctagaacagcataaagaggcgtaaatacattcatgagaatattgggacttgatcttggaacgaaaacactcggcgtagctttaagcgatgaaatgggctggaccgctcagggcattgagacgataaaaataaacgaggctgaaggagattacggtctggaccgtttatccgagctgatgaaagactataatgtagagaagatcgtgctcggttttccgaaaaacatgaacgggacgatcggtccgagaggcgaagccagccaaacatttgcgaaactgcttgaaacagcgtacaatgtccctgttgtgctgtgggacgagcgtctgacgacgatggcggctgaaaaaatgctgatcgcggctgacgtcagcaggcaaaaacgaaaaaaagtcattgataaaatggcggctgtcatgatccttcaaggatatctggacagtttaaactaagaggtgaaagaaatggaacacggcgaaaaacatattacaattgtcgatgatcaaggcaacgaacagctttgcgaagtgctgttcacatttgaaaacgacacattcaacaaatcttacgtactttattatccgattgatgctcaagacgatgatgaaattgaaattcacgcttcaagcttcgaaccgaacgaaaacggtgaagacggcgaactgatgccgattgaaaccgatgaagagtgggaaatgatcgaagaaacgctgaacacgtttttagcggaagaagacgaagaataaaatgaacggaaaaagccggagcgcatatgcgcttcggcttttttttgtaataaattgccgaatgcacatgaatcatgtagtataagagctgttgggaggaaaatacttgtatgaatatcaatcagactaaaaattcatttccgcgtaaaaacaaaaaaacaacgataatactgtcctccgtgatcgctctgcttatcatcatttgcggtgcttttttctatggaaaatctctgctgtccccggttgacaaaggcagcaaaacggcagtcaatattaatattccgagcggttcttccgtttcggcaatcgctgaaattcttgaggatcagcatgtcatcaaaagcaaaaaagcatttcagctgtatgtgaagtataaaggcgcttccgggtttcaggcgggattttaccacctgaataaaggaatggatgcggatgcgattatcaaaaaactgaccgcgggatcaacgggatatgcctttcagatctccgttcctgaaggaaaacagcttacacagattgcggatgcgatcgcaaaagaaacatcatattcaaaagaagagatcatggcaaaactggatgacaaaacattcatcggcaaactgaaaaaacagtttcctgatacaataacggacgcactttcaaacaagaagctcaagcatccgctcgaaggctatctgtatccggccacatatccgtttaatgatccggatgcatcgcttgacacgattttgacggcaatggttcaggaaacaaatacccgtatcgaaacgtataaatctgaactggaaaaaaagaaactttccgtccataacgcgctgacgatggcatcgcttattgaagaagaagccaccgccaaagccgaccgtcacaaaatcgccagcgttttttacaacaggcttgcagaaaaaatgccgctgcagactgacccgacggtattatatgcggccggtaagcataaaagccgggtctactacaaagacctgaaaattgattctccgtttaatacgtataaacataaggggctgccgccgggaccgattgcaaatgccggtgattcatcatgggaagcggctctccgccctgacaaaacggattatctctatttccttgcaaaaccaaacggcgaggtcgttttcaccaaaacattaaaagaccataataaagcgaaggaaaagtatatttccaaaaaagacagcgaataaaaggagggcaaaagctctccttttattccattctgaaaggttttatgataaaatatatcgggttgtttacttatggataaagaagtgtcttaagagagtgtccccgcggattcgtcaggggcactcctttttagaacggaggctgtttgccgtgaatgatcggtatgaacaaataaacgagtatataaacgcgatgctgaagcctcggcctgataaagtgaaaaagcttgaagcctatgcaaaagagcaccatgttccgattatggaagaagcgggcattgaagtgctgcttcaaatgctgtcgattcaacaggcgaaaaacattttggaaatcggcgcggcaatcggatattccgccatacggatggcgcttgagcttccggatgcgaatatttacacgattgaacgggacgacaaacgctatgaagaagctgtgaacaatataaaagactttgaaatggaaaaccgggttcgcgtaatgcacggggatgcgctggaactttctgagtctgtccgtgtcacggctccttatgatgccatttttatcgacgcggccaaaggccagtacacgaacttttttgagctctatgaaccgatgcttgcgccggatggagtcatttttacagacaatgttctgtttaaaggactggtggcacaaaatcactcggacattgagccgaaaagaagacggaagcttgttgaaaaaattgatcaatataaccaatggctgatgaaccggcctgactatcaaacggtcatactgccggtcggagacggcatcgccatcagtaaaaagaagaggtgaatgatcatgaaaaaacctgaacttttggtgactccgacttctgtacaggatattcttccgctcattcaagcgggcgcaacggccctgttagtcggagaacagagatacggcctgagactggccggtgaattttcaagagaagatataaaagaagccgtaaagacagctcatcaggaaggcgcgaaagtgtacgccgccgtcaatgctatttttcacaacgaaaaagtggacgagctgaacggctatcttgcctttttgcaggaggccggcgttgatgcggctgttttcggtgatccggccgttttaatggcggcgcgtgaagcggctcccgatcttaaactgcactggagcacggaaacaacgggtaccaactactattcctgcaattactggggacgcaaaggcgcacggcgggcagtgctggctaaggaattaaatatggacagcatcattgacataaaagaaaacgccgaagttgaaattgaaattcaaatccacggcatgacgtgcatgttccaatcaaagcgttctttagtgggccattacttcgaataccagggaaaagtcatggacatcgaacagaagaaaaaagaagcgggaatgtttctgcatgacaaggaacggggcaataaatacccgatttttgaagatgaaaacggcacgcacatcatgagcccgaacgatgtgtgcatgattgatgaattagaggacctgatggacgccggcatcgattctttcaaaatcgacggagttttgaagtctcctgaatacttaactgaagtgacccgcatgtacagagaagcaatcgatctgtgcttcgaaagccgagagacatacgaagagaaaaaagagagctggatagagcggattgaaagcattcagcctgtgaacagaagcatcgacacaggattcttctttaaagaaacggtctattaaaaaggagggtgcaacggatgacagccgtaaatcaaaccatttccaaagtcgtaaacggaaaacgcgtcattacgaaaaaacctgaactccttgctccggcaggaaaccttgaaaaattaaaaattgccgttcattacggagcggacgcggtttttatcggaggacaggaatacggactccgctcaaatgcggataacttctcaatagaagaaatcgcagagggcgtagaatttgccaaaaaatacggggcaaaaatatatgtgacaacaaacattttcgcccataatgaaaatatggacggtctggaagaatacttaaaagcgttgggagacgcaaaagttgccggaattatcgtcgctgatccgctgattattgaaacatgccggagagtggccccggacgtagaaattcacctcagcacacagcagtccctttccaactggaaagcggtgcagttctggaaagaagaagggcttgaccgcgtggtgcttgcccgtgaaacgagcggactggaaattaaagaaatgaaggaaaaggtggacattgaaatcgaaacctttatccacggcgccatgtgtatcgcttattcaggacgatgcgtgctgagcaatcacatgacagcccgggattccaaccgcggcggctgctgtcagtcctgccgctgggattatgacctgtatcagacagacggtgcaaacgcggtcgcgctttatgacgaagaagacgctccgtttgcgatgagcccgaaagatttaaaattgattgaatccattccgcaaatgattgagatgggtatcgacagcctgaaaattgaaggccggatgaaatcgattcattacgttgcgacggttgtcagcgtgtatcgcaaagtcatcgacgcatactgcgctgatcctgaaaactttgtcattcaaaaagaatggctggatgagctggacaaatgtgcaaaccgggataccgcgcctgctttctttgaaggcacgcccgggtatgaagagcagatgttcggcgaacacggaaagaaaacaacatttgattttgccggtctcgtgctcgcgtatgacgaggaaactcaaatggtgacgctccagcagcgcaatttctttaaacaaggtgacgaagtggaatttttcggtcctgaaatcgacaatttcacattcacaatcggcactatttgggacgaagacggaaacgagcttgatgctgcccgccatcccctgcaaatcgttagatttaaagtagacaaaaagatttatccgagcaacatgatgagaaaggggaagtaatcaccaatgggtaagagtcctgtagttataggcatcgcaggaggttccggatcaggaaaaacaagcgtcacccgttccatctatgaacagtttaaaggacactcgattttaatgatccagcaagacctttattataaagaccaaagccatcttccgtttgaagaaaggctgaacacaaactatgatcacccgctcgcatttgataatgactatttaatcgagcatattcaagagcttttgaattaccggccgatagaaaagccgatttatgattataaactgcatacgcgttctgaggaaaccattccggttgagccgaaggatgtcattattctggaaggcattctcgttctcgaagataaaagacttcgcgacctcatggatatgaaactttatgtcgacacggacgcggatctccgtatcatcagacggattatgagagatattaacgaaagaggccgttcaatcgattctgtcattgagcagtatgtgtccgtcgtcagaccgatgcacaatcagtttgttgaaccgacgaaacgctacgcggacatcattattccggaaggcggacaaaaccacgtcgcaattgatctgatggtcacgaagattcaaacgatccttgaacaaaatgcaattttgtaataccatagcatagacataaataactcagaccatattatgtataggctggaagggaatgagacagttcccttctttccctgtttataaaccgaaacatttgcagaaaacacacattcagtttaagataaacagtacctatatgggagagaagaacgaggactgccctgtgttctcattcttgattttttcgtttatgctctcatacataatcacacgttattgttgagggacaaccaccaaggagtgaaggaacatggcacaagaaaaagtttttccgatgactcacgaaggaaaacaaaaacttgaacaagaattagagcaattgaaaacggttaaacgtaaagaagtagtagagcgcattaaaatcgcaagaagcttcggagatctgtcagagaactctgagtatgattccgcaaaagaagaacaggcatttgtggaagggcgcatcacgacgcttgaaaacatgatccgcaatgcgaaaatcatcgaggacgacggcggttcaaatgtagtcggtttgggaaaaaccgtatcattcatcgaattgcccgacggtgaagaagaatcttacacgattgtcggaagcgctgaagctgatccgtttgaaggaaaaatctcaaacgactcgccaatcgcaaaaagcctgctcggcagaaaagtggacgaagaagtgacagttcagacgccgggcggagaaatgctcgtgaaaattgtgaaaatttcataagatccgtttaacaatgaaacacctcgtccaaaatgtggatgaggtgttttttatgatcgtatcaaaaaggctgaaaacggccgtgatttgttttctgctcgtgtttttctttctgcttgcaaggctggctgaaattcagctgttttttacagaatctttttcaaaatccaatattaatctgattcaggaaagcgtcaagcagcggacggaagaagtccttatttcagacggccgcggctcttttcttgatcggaacggcaaagaactgaccggaaaaaagcagcctgccgtcatactgtttccctttctcgtgacgcaggattggccggttgaccgggtatcagacattctcggaatgaaacagggggagctcaggcagctgctgacggaagcaaaaaaaccggtgatcctgaacagcagaaaaataaaacatttgacgaaacaatccgtggcaaatatcaattctttgaaatatcccggcatttacggcgtatatatgaaagacagcaaagaaacaaacatagccgctcatctgttgggcgcgacaaaccaggaccctgagcttttgaaaaagaaataccccggcaggaaggaactgccgatcacggcaaaaatcgggacaagcgggatggagcggacatttgatgagtttttactggcggatcaggacacaaaacttttgtatcatgtcgacggaaggggaaaccctttattcggaatggacgtcaaatatacggctgaagcaaacgcgttttatccgctgcaagtcaaaacctccatcgaccgcaatattcaaaaagcaatggaagatgtattgaaagaccgcgggttaaaaaaggggggagccgtccttttagacattgaaaaaagcagtgtgctcggaatggtatcaaagcctgacgccgacatgtcaaagcagcagacactgcaaaattacatgctgacgccgatttatccgggatcagtgtttaaaacggtgatcgccgcagccgcaatagaacaaaacgaagtgaagccgggcacatcctttaactgcaatctcaacctgtacggagagccgggggatgataaaggcacgctcagttttggagaaagctttgcccaaagctgcaattatacgtttacaagtcttgcggaaaaattgatcaaaaaagatgattccgttattgaaaacatggcggagaaactaggtctcacacagcgggcgggctgggaaggcaagctgtaccgggaagacggattcaggcagctgtataatgaaaaaagcggggtcatttggggagatgacaaagacaaaaccgtaaaaaaagccgtcgcacagacggcgatcgggcaaaaaaacgtgaaagtcacgcctcttgaagtcgccaatatgatggcggcgatcgcgcgcggcggtgagaaaaaacaagtcaaaatcgcggacaaaattgaatacaaaaacaaaacgacgatggcgtcattcaaagatcagccgttaaaaggggaaaacatcgacaaatatacggcgcagcagcttcaaaaaattctcagagaagtcgtcacctcaccgaaaggaaccggccgaaggtttcaggatctgccgtatgagatagcaggcaaatcgggaacggcccagacgggaatgttcacaaaagaaaaacagacgctttaccacaaatggtttgcgggatactttcccgcggacaagccgaaatacgctctcgtggtgctgcacatggacacgccgggggataaggctctgacaaatacagtgttttatgatattgttaaaaaggtacatgaaaatgaaacaaatcagacatagaacaaccgctcagcccatgttaaaatatatgctgagcaagagggataaaggagtgcagaatgattgagcaataaacaatctcgttttgaaaaccgtgataagcgcagaaaagcaaatatggtgcttaacattttaattgctatcgtatctattcttattgtcgtcgttgcagtcagcctcttcatcaacagtccgtcgagcgacgtgagcgaaaaagcggacacgagccagaagcaggaaacacctgcatcaggcaagacgaagcagacatcggatgaagacataaaagacagcaaaaaagatacggcatcagacgatgacaaaaaagataaacaggataaggacacatctgattcatcttcagactctgacagcaaaaaagacgatgattcatcgaaaagtgatgacagcagcaaaaaagactctgattcaagcgatccttttaaaggcgcaaaaataacagagggcggctcatcaagcgatgttgagaaaacaattgttaacccaaaatggaaagcggtcggaacaaagcagacgggagaacatgcggcgacgtatgactcaagctctgaagactggtccgaaatgcttgacgccatctcttacgcaacaggcgtgtcaaaagatcacatgacagtgctgtggctcggaaacaatggaagcccgcaagatgcgaagggtaaagttttagacaaaacgaacggcaaaaagtatcaggtcaccatcacttggaaagacaaaaaaggctggaagccgacaaaagtagaaacgttaaaataaccgcaaaaaagcagctgattattcagctgcttttttctgtcatacgtcagctgaaaaatgcaccgacgcgctgtaaaggattctgccgtcaacggccgtcacctgatgggatacagaacggacgcgaagcataatcgcctggttgttttcaacctgaacgtttattttcttttcaagctcctgcaaagatgccgcttcgaaaaattctactttatctttgattaaatccaattgaaaattcatcagtacagatcctcctgatttttcttctgagtcaatgaaagtataagcctttctgccgtaattgcgcaataatcccaaagtattttagtacccttccattcttttttgtgataggataggaactgttccacgattaatccatactatactcataggaattataaattatggagagtgaaaaatatgggccgtgaatttattccattatttgaagattgggcagcgacttatgatgccacagtgcacggggcagacaaacaatacgctgatgtttttaaagggtatgacaatattcttgacagcatcgtcgcactttcgggttctaacgttttagagttcggaccgggcacagggaatttaacggcgaaattagccgccgcgaacaaaaaggtgtttggtgtagaaccgtctccgtcaatgagaaaactggcggctgacaagctttctgacaaagccgtattcagtgacggagattttctggagtttcccgttccgccttttcaaatagataccatcgtcagctcgtacgcctttcatcatttaaccgatgaagaaaagcaagcggctgtaaagcaatatggcacaatccttcagaagcatgataaaatagtgtttgccgataccgtctttaaagatcatgaagcttatgatgaaacaattaaaaaagcaatccgaaacggctatcatcaattagcggacgatttaaagacggaacattatccgacactcgggacaatgaaaaacatcttttcagaagagggatttgccgcgcggtttacgcagcaaaatgactttgtctggataatggaggcgattaaacggtaaatcgaagggattgtgtataaatgaaactggcagtcatcggagcaatggaagaggaagttacgattttaagaagcaaactgaaagacgcaaaacaagagatgatcgctcactgtgagtttacgactggcagctatgaaggcgtcgaagttatcttgctgaaatcggggatcggaaaagtcaacgccgcgatcagcacgacgcttctgcttgaccgtttcaaacctgattatgtgattaacacaggctcagcgggcggttttcatcatacattgaatgtaggcgacgtcgtcatctcaacagatgtccgccatcatgacgtggatgtgacggcgtttgactatgaatacggacaggtgccgggtcttccggcagcatacaaagctgatgaaaagctgatcagtattactgaggaagcggtttctgaactgaacggcattcaagtcgccaaaggcacaatcgctacgggagattcttttatgaatgatccgaagcgggttgaagacgtacgcgccaaatttgcggatttgtacgcggttgaaatggaagctgcggctgtcgcacaggtgtgccatcagttcaaaacgccttttgttgtcatcagagctttatctgatattgccggaaaagaatctgacgtttcatttgataaatttttagaacaggctgccgttcattcaactgagcttgtcctgaatgtcatcaaacgaatttactaagcgggggattctcgttctcctccgcttttccaggaggaggacatatattgaacgtgataacagatattacagaactgatcggaaatacaccgctgctccgtctcaagcattttgatataccggagggaacagcggtttatgctaaacttgagatgatgaatccgggcggaagcattaaagacaggctgggcgggatgctcattgaagatgcgcttcgcacgggaaaggtgaaaccgggaggcgttatcatcgaagcgactgccggaaacaccgggatcggactcgctctgtgcgccagaaagcatcagcttcgcgccgttttttgcgtcccggagcatttcagcagagaaaagcagcaaattatgaaagctctcggagcggacatcgtgcatacgccgagagaagaaggtatgcagggagccattcgaaaagcgcttgaactggagagagagattaataattcttatgccgttctgcaatttaaaaaccgagtaaatccattgacttactataaaacgatcggacctgaaatatggaacgcgctcggcggggatatccacacctttgtcgcaggagcgggttccggcggcacctttgccggtacggcagcttatttaaaggagaaaaatcctgccgtcaaaacggtgatcgttgaaccggaaggctcgatcctgaacggaggagagccgcatgcccataaaacggaaggcatcggcatggagtttatcccggattatatggacgagaaccattttgacgccatttacacagtggaagacgatacggcgttttcgcttgtcagagaagcggccgagaaagaaggcctcttaatcggaagctcttcaggggcggctctttatgcagcgcttgaagaagcgaaaaaagcgcccgccggatcaaatatcgtcactattttccctgacggcagcgatcgatatataagcaaaaacatttttcaaggaggtcagtaagatgaagaaaaaaacgctgatggtgcacggaggaattacgggagatgaaaaaacaggagcggtttccgtaccgatttatcaagtaagcacgtaccggcagccgaaagcgggcgagcatacgggttatgaatattcaagaacggccaatccgacgcggacggcgcttgaaagcttaattgcagagcttgaaggcggcgcggcgggatatgcgttcggctcaggcatggctgcgattactgccgtcatgatgctgtttgacagcggcgatcatgttattttgacggatgatgtatacggcggcacttaccgggtgatgacaggtgtgctgaaccgcttcggtattgaagcggactttgttgatacgagcagtgaagaaaaagtcaaaaaggccattcgcccgaatacgaaagccatttatatcgaaacaccgacaaacccgctattgaaagtgactgacctcaaactgatgtctgacatcgcaaaagaagcgggcgtattgcttatcgtcgataatacgttttacacgccgtatttccagcagccgctcagcttcggcgcggacatcgtgcttcacagcgcgacaaaatatctcggcggccacagcgatgtcgtcggcggcttagtcgtgacggctgataaagagctcggtgaaaagcttcattacgtgcaaaactcaacgggcggcgttttaggaccgcaggattcatggcttttaatgagaggcattaaaacactgggactcagaatggatgccatcaatcacagcgccgggaaaatcgccgagctgcttgaagcgcatgatgccgttcagacgctctactatccgggatcagcgaaacatccgggccatgagctgacaaaagcgcaaagctccggtttcggcggaatgatttcctttgatatcggcagcagtgaacgcgtcgacgcgtttttagaaaaattgaacctgtttacaatcgcggaaagcttaggagcggttgaaagcttaatctccgtgccgtccagaatgacgcacgcttcgatcccgcgcgaccgccgtcttgcgcttggcattaccgacgggctcgtacggatctcagtcggtattgaggatactgaggatttaacggcggatgtgaaacaggcgcttgattcacttttataaagaatggatagatttacattctctgtcggctgtcagcttgtattataatgttggtagactataaaactggcaggtgaccttatatggagaagaaaagactgaaatcattaatagaagattttaagcattacgcatttattctgcttgcagtcagcaccttcatttatattggcgcggttcttcccggacaagggctgactgcgggccagaaaatgctgatgtttgtaacggattgtgcatttttagcgggcgcttatttctgcgttgaccgttcacttatttataaaaagaggctggaagaggccgaagaataaaaaaaagccattgtcttttgacaatggctttttcatttcttattcagaaggggtttcgcgtaattcttttcccattccttttaaaaactgcagcccgaagccgagcgcgcggttaatatcaggatcaccgacggctttcatcagttcaaacatactgactttcctgtcctcttttaaaaatctttgcgcctgatccgtcccggccatggcgctttctaaaagtctgcccataaattcgggatcagcttttgacagcgcgcctcccgcggccatcatcgtattcaggagattggtgacaggttcccgggaaatctgtccgagtgcgattttggcaatctcctcttttgcctggagcatatagccggcggcatcaaaaatgcccaagccattcagctctgccataatggacatcgttttcgcgacggcttcttcattttctgcgagaagcgtcttcagttcttccagtttttcagctttcagctgttcctctgttttcgtttctttttgaatttcagtaattgggcttgccattatgtttcctcctttccttaatcagttaggtgcacatagcccggacggttccattttcgctgagcttccacaccgttttgcggatgacgttttttgttccgcggattcgttttcggaagcggcggtgtatcacaggaaccgagcacttccatgcggacttttgtctgtttataggcaggtgtatgtgtccgtgaatcatacgcaggcccggtcaggaaattaatcgcagaatctttatctgtagagttcatcggcagataaagctcatttgcgcggacacggtctgtcacaagcgcattcaatttaaccgccccaaaaggagagacgagccggatcattgttccgtcgcaaattccgcgttcagccgcgagctccggcgatacttcaacaaatacatccggcactttagactgaatgcccttcgatttgtttgtcatgtttccttcgtggaaatgttcaagcatccgtccgttgttaatatgcaggtcatattcttcagggaatacggcaggctccacccaatcgctcagcgcaaaacgggcttttttgtccgggaagttaaagccgtcttcataaagaagcggagtgctctctcccgtaaagcttccccacaggaagctgttccagccgctaagaacgtcgtagcttgcttttccgaacagaggagaaaggctcgccatttctgagaaaatgtcgcttggatgcgtgtaattccaatcagcgcctaaacgattggcaacctcctgaataatccaccagtcgggtttggcatcgccgagtgtcggaagcgcctgatacaatctttgtacacgacgctctgtgtttgtaaatgttccgtctttttcaagagatggaaccgcaggcaggatgacatccgcgtattgcgccgttcttgaaaggaaaatatcctgtacaacaaagaaatcaaggctggataaaatgtcatgaacatggttggcgtttgaatcgacgagcgccatatcttcaccgacgagatacatggctttcatgtttccttcttcaatcgcatggagcatttcaatattatcaagacccggcttgccgtcaatttcaacaccgtaagctttttcgaatttagcgcgtgccgcatcatcggtaatatgctgataccccggaagccagcctggaagagttcccatatcgcaagcgccttgaacgttgttatgtccccgcagcggataagctccggcgcccggacggcggtagtttcctgtggcaagcagcaggttggaaatcgccgctgatgtatcagagccgcctgtattctgggtaacgcccatgccccaaagaacacaagtgccgtctgcatcacgaatcatttcggcaatgcggatgatcgtatcctgagaaagtccggtgatgcgctccgcatattctaatgtatactttttcagcgtttctttataatcttcaaagtagttgacattctcatcaataaacgcttgatcgtgccagccttggtcaatcatatattttgtcactgccatgagccagacttggtcagtcccttgtttcgggctgataaagaggtcggaccgttcagccatttcatttctgcgcagatcggcaacaattaatttttgtccgtgcagcttatgtgcacgtttcacgcgtgtggccagaaccggatgtccttctgccggattggcgccgacgatgagcacgaggcccgcttttgcgatatctttaattgtgccggcgtcaccgcccataccgactgtgcggaataagccgtccgttgccggtgactggcagtagcgtgaacagttatccacgttgttggtttcaaatacttgacgcgctaatttttgaataacgtagttgtcttcattcgtaattttagaagaagaaataaaaccgacagaaccatttccgtgttcggccttgatcgaaccgagtcttgaagcgacaagatcaagagcttcttcccatgacgattcaacaaatgcgccgtttttccggataagcggttttgtaatccgttcttccgaatttacgaagtcccagccgaatttccctttcacacaagtggaaatcgcattaaccggagcatcggaaacaggctgaattttaaggatgtcacggccttttgtccatacttcaaaagagcatccgacgccgcagaacgtgcagactgtttttgtttttttcgtccgtttatcgcgcatagccgcttccacttctgacacggcgaagatgcttgtatagtcgggttcaacatttttcactaaatcaatcatcggttccatgacatcttcttttattcctgtcataaatccggcttggccgagcattgatttttccatcagtgcgttacaagggcagacagtgacacattggccgcagctgacgcaggatgattcattaatggggacgccttcatcccaaatgacccgcgggcggtcgcgctcccaatcaattgaaagggtctcattcacctgaaggttttgacacacttccacacattggccgcaggcaatgcattggttcggatcatagcggtaaaacgggtgagacatatcaaccgcgcactttgaatcatctttcggcgtatacggatatttctgatgctcaattcccatcatttccgctgtattatgcagtgtgcagttgccgttgttgttatcgcataccgtacagtaaagcaggtgattctcgagcaggcggtccatggcctctgtctgagcctcttttacccttcccgacgtaagcgagatggacatcccgttttctgcagccgtggaacaagagcgctgcaatttcccgtttacttcaacaatacaggtgtcacatgtttgaatcggatctacttccggtacatggcatatttgcggaatctcaattccgttttggtttaaaatatctaaaatcttagacccctctggtgcttcatactccgtgccgtcaattttgacacggatagactgaacgtctgtcacttccaattcccctccatcttttaaactcgaaaaaaagccatgcacatagataccggcctcctgtccggagaacggtataaatacgcatggcggaatagttcactagcaagtcttactaacagaccaatcctatttgtataaaacgatagactcataacacgtttcctattacaaatccatcttcactgcttttattataaggtgatatttattataatacaatacgaaaggaaaactttaaccaggtgaaatgtcacaaaggggaaccgggaatgtctttcataggctaaaatcggaggggacaatatgtctaaaaaaattcatgaatttaacgatattatccggaaattgcgcaaagaattatttggaaaggggccggaacgaattcacaccgtttttgtggataacatggcggtatcaacgctttacggcaatctaagcgcaagtgagcagtttatcgcacgcacgcctgaaggaagagaaatggttcatgcggcgcggaccagcttaattcaggaactgtattcaaaacaaacgcctgacggaatggaagagctcatcggagcaaagctcgtgcatctgttttcagacatcaagatcgaagagaatattgcggtgtctgtatttgtctttgaccgaacaattgaagagcgccgtgaagaaatcaaaagctgaaaaaaattcaattgacacgaaattgtcacatttgatatgatatgaactgcctgcagtggcttaaggacgaattttatggaatgtgtgcatgatctgtacattttctatagctgatattttcattctgcttgatattgttgtatgggtatgcatacaagttaggcagcattcaaacccgttttagacgggctgtttgaatgctgccttttttgttaggcgtctttggaaactgcggggctgaaatgataaatggaggggttattatggcttttcgtaaaccggacgaaatagcggagcttgcggtcgaatcaggggtaaaaaaggtgcattcaccgctttcagcactgattgtattaggatttttgggaggagcgtttatcgcactcggttatttgcttgatatccgtgtcatcggcgaccttccgaaagaatggggaagcttgtcgagtttaatcggggcgtccgtgtttcccatcggattggtgctcgtcgttcttgccggcgcggagctgattacgggtaatatgatgtcggtatctatggcgcttttttccagaagaatatccgccggtgcattagtgaaaaattgggtgatcgtgacgttgatgaatcttgtcggcgcactgtttgtcgcttactttttcggacatgttgtcggattaaccgaaacaggaccttacttggaaaaaacgattgcggtcgcacaaggcaaattggatatgccgtttggaaaagttattgtttcggcgatcggctgtaactggcttgtctgtttggccgtctggctttctttcggcgcagaagacggagccggaaaaatcgcgggtatatggtttccgattatggcgtttgtcgcgattggttttcagcacgttgtagccaatatgtttatcatcccggctgcgatttttgcaggttctttttcgtggggtgatctgattggcaatctcattccggcctttatcgggaatgtaatcggcggggcagtgtttgtcggccttatttattttattgcatattcaaaaaaagatcagaaaaagcaagggatgaaaagagtttcctgaggtaagaaagatgccggaaaacaaggacaattgaagcggaatgccagcacattttccgtccaaatcttgaaaaaaatgtttacaaaatggaagctgatggatatacttacaaagtaagaaaaaagcaaagggaggttgaatcacatgacgactttaaacggcaatcaaaatttacaattgaaccgattcagcctgtggaagagttcgtgtccttccttaacctctgcccgtcaagcacgttaatttcggagtatcaggacattcgcagctccccgcagggaaagaagcacgtcttcttttgtctgcggatttagtctgcccgcagcgcatatgaagtttgctgcgggttattttcgcttgtgcggatattgaaagggggtgagcgataatgaccattaatcttttctttttaacactgaccatttcaaagcgttttaaaagtgcggaagagtatgaacgagaacagcaggtcgaagagttttataatgaagcgaaagaacgccagctgaaacacttttatatgaactgaacggacacgaagggccaaaacggaggagaaggaggagatcatcatgttcagaattgaactgctgaatcattacacaatggagaaggaccaggtttagcgaggatgttgctgtcacgtcgcagacggcctgcataccatggtaaagaaagaaaaattggtaagcgggtgatagcatgcaaggcggtcagaacagaattccatccatcgggcacgggtatgcgtcaatgccccattcatttaaacacggctacggcaacccgtatcgccggcagagaatggcggcgctttcccggcagacaagatatatagcaccgtattattggtactagagcaggcggaaaacctacgttttccgtcttttttttatgaaaacaaatataaatttcaaataaatcgaaacgttcatgaagagaagtgcgtctagttagtacctcatactaatacgaggtaatattatttctgaataataaatcacaggaatggaaaagcgggtgttatacaatgttgcaacatacatcttcagcattaaaacgaatgcgcgcgaaatactttgctgcatcagaaccggcagagtcagtcattcagcaaatcttgatggacatacaggaatacgaccgcattttggaaatcgggaccggaaacggctcaatgtttaaacaaatcatcggacagcttgaaaagggcagtcttaaaagcatagaaacatcgaaacgtaaaatacggaaaacacagcgcgcaaaccgttcggttataaaagccgggcgcggaaacattcagcaggggaggcctgaaagcttaccgttccgcgatcgcagctttcataaagttttctcattacatactgctgaaacagtcagcgattacaggacagcatgtaaagaagtgtaccgcgttcttcaaattgacgggtgtttctatatggttttgaaaccttcgcggatgagtgagaaggatgtgattgaggtgctctatgatcagcatttcagagacatttcagttgtcagcagagattcgttccattttattactgccattaaatagaatatttcttgggaaataaaaagagctgcttaagtcactgcagctctttttgtgaaattgggcatatttccttatttttggttatttcacatctattttatattaaaaaaagtttttttcttatacaatggtaatcagatgaccgtacattttaaatgttttgaacaaacggaatgaatattcattccgcatctggaaagggggatgaaatgacagcttcaaacaaggttgaactcattatgaaagcgtcgcttactttgtttacagatagaggatttgacgcaacgacgattccgatgattgccgctcaggccgatgtcggaaccggcacaatctaccgttactttgacagtaaagagacacttgtgaacgtactgtatcaggaaagtgcgcagcgttttatgaaaaaagtcaaaacggactttcagggtatctctgtaagagaagggtttcatcacctgttttattgtctgattgattttacgaaggaaagtgagtatgcattgttttttcttgaaacgaataaggacgcctactttctgaatgaaacaagccgtaagcttcttgatgaaataacacagatgcttgacgtcttttttcagcgcggcaagtctgaaggtgtgctccgcaatctgccgtccaatgtgctgatggcgctgctgctcggggcatatctcaaactctatcagcttatccggacgggaagcgtcgaaataacaaaaccgtttctgaaagaactggaacaatgttcttgggatgccatcagaactcattaattattcgccgaaggaaggaagatcgatatgaaacagctaagcgctataccgcagccgaaaacatacggacctctgaaaaatctccctcacttggaaaaagaaaaactgtcacaatcgctctggaaaattgccgaagaatacggcccgatctttcgtttcgaatttccgagctctgtcggggtcttcgtctcaggccgcgagctcgcggcagaagtctgtgatgaaaagcgatttgataaaaatctcagcaaagccttgctgaaagtccgtgagtttggcggtgacggactatttacgagctggactcacgaaaagaattggcagaaagcgcatcggattttattgccgagcttcagccagaaggcgatgaaaggctatcattcaatgatgcttgatattgccatgcagctcgtgcagaagtggagcagattaaatccgaatgaagaaattgacgttgccgaagatatgacgcgcctgacgctggatacaatcggcctgtgcggatttcattaccgctttaacagcttttaccgcgacacacagcatccttttatcacaagtatgcttcgcgcgctgcaggaggcaatgcgccaatcacagagacacagcctgcaggacaagctgatgatcaaaacgagacatcagttccagcaggatattgaagtgatgaatgaactcgtagaccggatcatcgctgagcggagggaaaatccggatgagaatctgtctgaccttttagcattgatgcttgaagcgaaagatcctgtaacgggtgaaaggctggatgatgaaaatatccgctatcaaatcattacctttttgatcgcggggcatgaaaccacaagcggactgctttcattcgcgatttactgcctgctgaaaaataaagataaattgaaaaaagccgttcaggaagccgagcgggtgctgacgggagagacacatgaatataagcagattcagcagctgacatatatccgcatggtgttaaacgagactttgcggctgtatccgactgccccggcattttccctgtacgcgaaagaagatacggttctcggcgggaaatatccgattgcgaaaggacagccggtgacgattctgactccgcagcttcaccgggataaaagcgcgtggggagaagatgccgagctattccgtccggaaaggttcagcgatcccgcggcaattccggctgatgcgtataagccgttcggaaacggacagcgcgcatgcatcgggatgcagtttgccctgcaggaagcgacaatggtgctcggccttgtccttaaacactttgaactgattgatcatactgattatgagcttacgattaaagaagctttaaccattaagcccggtgattttaaaatccgtgtaaaaaacaaggacgtgtccaatcatcagcccgtacaaaaccataaagctgaaggcggcggtcacaaagaagaaacgaaagaaatcccgtcccacggaacgccgcttctcattctttacggttcaaatttgggaactgcggaaggaatcgcggaagagctggctgacatcggcagaagcaaaggattttcaactgaaaccggcccgcttgatgattatgccgggaaactgcctgtaaaaggcgcagtcgttattgtgacggcttcttataacggggcgccgcctgataatgcggtgggttttgtgaaatggacggaaacccttgaggatcaggaattaaagggtgtttcttacgccgtcttcggctgcggagaccgcaactgggccgccacttaccagagaatcccccgcctgatagacaaagtgcttgaagaaaaaggggcaaaacggctgacttctatcggggagggcgacaatgccgatgattttgagtacagtcaggaagcctgggaagactcattctggaaggacatcatgaaggcttttcatatagaggccgctccaaaacaggcaaacaaatcacagttatcaatcgaatacgtaagtgaagcagccgagacgccgattgccaaaacgtacaaagcatttgaggcggaagtcatcacaaacaaagagcttcataccgaaagcagcaagcgttcagtccggcatattgagctgcgtctcccgaagaccgaaacgtatcgggaaggagaccatctcggggtgcttccgcaaaacagcggggaactgatcagccgtgtcattcgccgattcggtcttgatccgaaccagcactttaagatcaagggccggcagctgcctcatctgccgatggaccggccggttaatgcgccggagcttttggcgtcatatgtagagctgcaggaaccggcaacgagagcccagcttcgcgaacttgccgcccataccgtgtgcccgccgcaccaaaaagaattggagcatctttattctgacgatgcggcatataaagaaaacgtgctgaaaaaacgaatgaccatgctggacctgctggaagattatccggcttgtgaactgccgtttgagcgctttttagaacttctgccgtccttaaaggcgcgctattattcaatctcaagctcaccgaaggcaaacaaaagggagctcagtatcacggtcggcgttgtgacggctccggcgtggagcggccggggagaatacaagggcgtggcttcgaactatttagccggattacaaaatggcgattctgccgtctgtttcatccgctcgccgcagtcgggtttcgcattgcccgaaaatacgaaaacgcctctcattatgatcggagcaggcaccggaattgcaccgttcaggggatttatccaggcgcgggctgcagaaaaaatgtccggtaacagcctgggcgaagctcatttatacttcggctgcagacaccctgaagaagacgatctgtacaaagatgaattcgaccatgcggagaaaaacggccttgtcaccgtgcatcgggcgtattccagattagatcaggactgtaaagtttacgtacaggatgtcctgcttcgcgaggctgcacagattattgcgcttcttgaccaaggcggccatctctatatatgcggagacggaagcaaaatggctccggctgtcgaaaatgtactgcttcaggcgtatgaaaaggtgcataacactgattcaaaagtttccttgaattggcttgaacagctgcaggcggaaggaagatatgcgaaagatgtttgggcaggtgtgtaacagaagcgtaaggcaattgaagattgtgttttaattgaagaaagccggcacgatatttgaaatctactgaatcaaaaggaatagttatagggagtatcgtgccggccttatctttagtatcggacaaaagaaacaaatctttaatgtttttattgatttacatgcaggcggctatgtcccttttttctgaattccgccacaaataaaaccggataagacagcaatagcaaaaccgaaataaatgaaatgataccgatccaatgaaaatgcgtccaaaagaaaccgccgcaagacccggccacgcttgacccgatatagtatgcaagcagatataatgaagaggcttgcgcgcgctgatcaccggctgcgcggccgacccaggcgcttgcaattgaatgtgcgccgaaaaagccgaaggtaaagacggcaatgcccgcaattttaagggcaagctggggcaaaagtgtcaccgctgcaccggccagcataacaaaaatcgcaatcttaatcatttttgaacttccgaaaaggtccgcttttttccccatatagacagagctgaacgttcccgcgagatagacaataaaaataaaaccgatcacagtctgtgacaaatgataaggagccgccattaaatgaaagccgatataattatataatgtcacaaaactccccattaatataaatcccagagatattaacaaaagcagccgtttgcggtgtagaaccgctccgtattccttacatgccgcttttacgcccgcatgccgctgagacgaatggcgcggagccggaagaaaacgccaaaacaaatagcttaatacaatagaaagaatgccgataatggcaagcgccggccgccagccgaatacatcagtcagaagccccgttaacagcctgccgctcattcccccgatgcttgtgccgctgatatacaggcccatcattttcccgaggcccttcggatcaaactcctcgcctacatatgtcatagcgacagcaggaacgcctgccagaaaaataccgagcagccccctcatcgccaaaagcgccggaaaagccggactgaacgctgttaatagacctaaaacagaagtagctgttaacgacagcaccattaatttttttctgccgaatccgtcagacaacgaagcagcggccaataatgaaaatgccaaaacggctgttgagatggataaagttaagctggcagccgcagcggaaatatgaaactcttccgaaaacaaaggcataagcggctgtgtcgtgtaaagcgtggcaaatgtcacaaagccgctgataaacagagccaagctggccttcctgtaagcctttgtatgaggctgaataaacgtcatgaatgtccctcttttctcactgttggttatatatgtatcgtacgcttttcatttcaatgtgtctaatttataataactatagaattaatgcgtttaggttatgagggaaggggagaaggagaaaatggagcttcatcaaattgacaactttattgcggcggcaactcatcagcatttcacaaatgcggcaaaagaaaggatgatttctcagccggcattaagccgatcgattatcaggctcgaagaagaattaggcgcgccgttattttacagagagacaaaagccgtccggctgacaaggcacggagagcagttcttaataaaagcaaaacaagcgagacgagctttaaatgaaggcgttgaacaagtgaaaaaaaatatgagcctggaacacggcgaaatatctgtatcttttcttcatacgctcgggctgcgcttaatgcctcagctgattgccgaatttaaaaagctatacccaaacgtcaccttccggctttatcaaggcgcaaatgaaacgcttcgcaaaatggtggaaacgggagatgcggatatctgtctcagctccccgccgcttcccagcgagcttttacaatggacagtgctggagaaagagcctctttatgcggtgcttcctgagaaccacccgcttgcagaaaataaaagcattcaaatgaaagagatgcaggacgaggattttgtcggatttaaaccgggatacgggctgagatatatgtttgatctgatgtgccgggatttgaatatacacccgcatctcgcatttgaaggagaggaagtgtcaaccatattagggctgaccgccgcgggtcttggggctgcagtgctgccgaaaaccgcggagcattcatactttccggtcgtttttctcccggttgcagattaccaatgcgaacgcaccatagcgttagcccagttaaaaaaccatgctctctctcccgctgctgagcgttttaaacagtttgcacttgattattacaaagcacgcaactgagcggtcattttattaaaatcgaagttgaaaataaagcagaaagaaatacagaaaacggaggaaaaccatggcgaaaaaaacagtgaaaacaaatgctgtccgtatcattgagcagcaaaacattccctatgagctattaggttacaaaacagaaggggaacagcccgcagacggtctttccgtttcacaaaaaatcggatactctgccgaatatgtttataaaaccttagtggcatctgcaggaactgatcgttattacgtctttgtcgttcccgttgcaaaagaactgaatctgaaaaaggctgcgaaggcggcaggtgagaagaaaatagaaatgattgccatgaaggaccttttgggagtgaccggctatatacgcggcggctgctctccgatcggaatgaaaaaaaggtttccgacttttattgataaatccgctgaaacactggcgtttatgattgtcagtgcggggaaaatcggaatgcagctgaaagtagcgcctcgagatttagccgaagcaagcggggcggtatttacagaaaatgtataaatgtccggtggatctaatggaatacacgtttcaagggagaatgataatgaaaaaaagatatgaaaacttgaatggcgtaaagaatgaacatggattcatggacatgtggaaatggatgaaagaacgaagagaaaaaagtaaagatttaagcgcgaatattccgaaagcggtcacaagggatgtccgtgatgttgccgtcaatcggacggaaaccgccataacatggatcggccattcttcatttctgatccaaatacaggggcttaacataatgaccgaccctgtatgggcgcggaggatgggttttcaaaaacggctgacagagccgggatatgaattgagcgaactgcctgacattgatgccgtgctcatctcacatgggcattatgaccatcttgattttccgagtataaaaaaactgagaggaaacccggatttttacgtgcctgcgggactgaaaaagctgttcatcaaaaaaggccgcaaaaaggttcatgaaatgaattggtgggatcgttttgagatgcggggggtgaatatatcatttgttccggcccagcactggacacggagaacgctttgggataccgatacctctcattggggaggctgggtcatagaaagcgaaaacggcgagtccatctattttgcaggagatacaggctattttgaaggctttaaagaaatcggagagaggtttcgtattaaggcggctctgatgccgatcggagcatacgaacccgaatggtttatgaaagtgtcacatatcaatccggaagacgccgtgaaagcttttttagagctgaaggctgacagtttcattcccatgcattacggggcattccggcttgctgatgatacaggcccggaagcattaagcagactgcacggcgagtgggcccggcttgcattacctcctgaaaacctgagagcattggcgcttggcgaaacattttggctgtaacagcaggttttcgctgccgacaccaatcgtttaaaaacggttggtgttttgttgtcaaccaaaggtgaacagactcagtataaaacatgatttttccggaatctgcggtaaaaaacaaaactttttactcttttgtttcactatacaatgaaaacggtttcgtatgcgcggtatatttaacctatcacaattgctccagcagaaacggacaggaaggatagaaaaacagatgaaatacatgaattcaagacagaaaaagattttgtatctgttgttatctgaacctgatgactacttagttgtgcaagatttcgcagacagggtccgctgttctgaaaaaacgatcaggaatgatttgaaaacgattgaagattttctgaatgaacatgcgcaagctcagctgatccgcaaaccgggattaggcgtctatttacatatatctgaacaggaaaggtcacggttaagccggcatatttataatgagcactttacatgcaggcacaagaccgatgaagaaagaatacttcacatcgcttatgatttattaatgaattcaaagcccgtttccgcaaaagaaattgccgcacagcattttgtaaacagagcttccattaaaaaggatatcagtgcggttgaagagtggctgaagcgatttgatctcacactggtttctaaacagcggctcggcttaaagattgaaggggacgaaaaaaacaaaagaaaagcattggcgcgaatttcagatttgattgataatgcggagtttacaagccaatttataaaaagtaagtttttaagtcatgaagcggactttgtgagaaaagaaatcaagttattacaaaaaaaccattctatctattttacggatgaaacatttgaaagtttgctgctgcatacattgctgaccatccgccgtatcaaaatgaaacagccggtcgccatctctgcaaggcagctggaggcggtaaaaaagaagaaagaatatgaatggacactggcttgtttaaaacggcttgagccggtatttgccatccggtttcccgaggaagaagccgtctatttaactttacatataataggcgggaaagtgcgctatccattgcagcaagaaaagaagcttgatcttgaagattctgagctttccaaagtcgtcaggcatttgatcaatcgcgtttcagaactgaaaatgctggatttccataaagaccaggaattgatcaatggattgaacattcatctcgatccggtgttgaagcggctgagctatgatctctctgtttcaaaccccatgctccacgatatcaaaaaaatgtatccttatttgtttcatcttatcattgacgttttagaagacatcaatcaaacatttgatctttatattcctgaagaagaggcggcctatttgaccctgcattttcaggcagcgatcgaacggctgcgccgaagcagtcataaccctaaaaggacgatcatcgtctgccatatgggcattggcatgtcgcaattgctgcggactaaaattgaacgcaaatttcatcacattacgataaaagactgtatcgcaaaagcggaactgacagagtatatcaaaaagcataaagatatagatttcgtcatttctacgatagggcttggaaatgtaacgatccctcatatcgtcgtatcaccgcttttggagcctgctgatgaaaagaagctcagcgcatttatgcaacagcttgatacatcacaccgcctggagcaaaaaacgtttaaaatgctgaatgatacgactccgtttctcgtttttttacagcaagagacagagcaccgttatcaggtcattgaaaagctggcgcaggctttgtatgaaaaaggctatgtagaaaaagagtatggcattcatgcagtaatgagagaaaaaatgtcggcgacaaatatcggggcgggtattgccatccctcacgcgaactctaaatatatcaaacaatcagccattgcaatcgccaccttaaaagagcccattgagtgggggacggaaaaggtgtcgcttgtatttatgcttgccgtcaaacacgaagatcaaaacaaggtaaagcaattattcagtgagctttcctatcttagcgagcagccggcatttattcaaaaactgacggaagaaaaaaatgtgatgacgtttttatcgtatttaaactattaaaagcaggggatggctccctgctttttttctgtttatagggaaaaatgccgttatttccggaacttatggtaaaaaaacgcgcttatcacaggctgatttcagtataaagttgagacaagatcttgaaattcagactgcaaaggaggatttatatgaaactgttagcgattacatcatgtccgaacggcattgcccatacgtatatggctgctgaaaatttacaaaaagcagccggcagattaggcgttgagatcaaagtggaaacccagggcggaatcggggtggaaaataggctgaccgaagaggaaatccgggaagcagacgcaatcattatagcggcggaccgttcggtgaacaaagaccgattcgcgggaaaaaagctgctggccgtcggggttcaggaaggcatccgcaaaccggaagaattaattcaaaaagcgcttagcggtgaagtgccggtctatcaatctgcttcaaaagctgaaaccgcaagtcagcaaggcaaaaaacaaaatccgatttaccgtcatttaatgaacggcgtttcttttatggttcctttcattgtcgtcggcggattattgatagcggttgcattgacgcttggaggagaaaaaacaccaaagggcttagtcattccggatgcgtctttttggaatacgattgaacagatcggcagcgcttctttttcattcatgatcccgattttagccgggtacatcgcgttcagcatcgccgataagccgggtcttgtccccggaatgatcggcggatatattgcggcatccggcagcttttacgacagtgcgagcggcgcaggatttcttggaggaatcattgcgggatttttggcgggatatgcggcgcttggaatcaaaaaatgtaaagttcctaaagcaatacagccgattatgccgatcattattattccggtgtttgcctcactgatcgtcggtttggcgtttgtatttctgatcggcgcccccgtcgctcatattttcgcatcattaacggtttggcttgcgggaatgaaaggctcgagctcaattctcctggcattgattttaggagcgatgatctcctttgatatgggaggacccgtaaacaaggtggcctttctattcggatcggcaatgatcggagaaggaaattatgaaattatgggcccgattgccgtttccatttgtataccgccgatagggcttgggattgcgacgtttttaggaaaaagaaaattcgccgccgcagaaagagaaatgggaaaagcgtcatttacgatgggccttttcggtatcacggaaggagccattccatttgcggcccaagatccccttcgtgtgatcccgagtattatggcgggttctatgaccggctcggtgatagcgatgatcggccatgtgggggacagagtggcacacggcggccccatcgttgctgtacttggagcagtagatcatgtattgatgttttttatcgctgtaacagcaggctctcttgtcaccgctctgttggttaatgtactgaagaaagatatggcgaaatcccccgcgcccggtgaggtgctgccgtctgccgcaccaaatgaagctgcagcggcaaaagaaacaaaggaaccatctcaggctgacagccgaaaagccgggatgaccgaaatcaaaaaactgactgacattatcagtacggacttgattgaaccgcatttatccggcgaaacgcgggatgacattatcgatgaaatgatcgagaaattgtcccgtaaaggtatgctgctgtctgacagcggatttaagcaggccattttgagccgtgaacaacagggaaccacggcgataggtatgaatatcgccattccgcacggaaagtctgattccgtcagaacgccgggtgtcgcattcggaataagacgttcgggtgttgactggaacagccttgatggttctgatgcaaaactgatttttatgattgccgtaccgaaggaaagcggcggaaatcagcatctgaaaatattacagatgttatcccgaaaactgatggatgacagctatcgggaaaggctgctctccgttcagacaaaagaagaggcgtatgagcttctggaagaaatcgaataaagcgggggatgatcatgtctactgaaccgatatttttcaatccggttttcaaagaaagaatttggggaggcgccgccctgcgtgattttcactataatattccgtccgagcggacaggggagtgctgggcctttgccgctcatcaaaatggacagagcacagttcgaaacggcatgtataaaggatgtacgctcggtgaattgtgggagcatcacagagatttattcggaaaccttgaaggagaccgttttcctcttcttacaaaaattttggatgcggaccaagatctgtccgttcaggtgcatccgaatgatgactttgccaaaatgcatgaaaacggggaacttggaaaaaccgaatgctggtatatcattgattgtgaaaaagatgcggagatcattttcggccacagcgcaacaacaaaagaagaactgatatccatgattgagcgcggagaatgggacggacttctgaacagagttaaggtaaagccgggagatttcttctttgtcccaagcggcaccgttcacgcgattggaaagggcacacttattttagagacgcagcaaaattcagatacgacttacagattgtatgattacggaagaaaagatgcggacggcaggctgcgcgagctccatttggaaaaaagtatagaagtgacagacgttccatctgtccgtgaacggccgaccgttcaatataaacaaacagatgatctgctggcagctgttttaatagaatgtccttatttttcagtcgaaaagtgggatgtaaaaggtgaagcgaatttattccagaatcatcccttccttcttgtcagcgtgatcgaaggagacggaataataattgcaggcgggcatgaacatccctttagaaaaggagatcacattctcctgccttccggtttgggagaatataaactggcgggccatgcaaagtgtattgtgtctcatctgtaatcttcaaaacccttctctggcagcagagaagggtttttcatcacttttacaaaaaggccgaaatttccgtggtccgttcctgaatttaatctctcaatttgtatatctcccgagccattgattcaagtatgtacatagcggggatttgggtggtgatattcgcattttcaacccattcttccgtcacgtaatatgaaatattcacatcagacattttggcaatggttgaatgtttatgatttgtaatactgatgacccggcttccttcttgtttcagctgattcagatgagtcaccgtagaatctccttcacctgaaaccgataatgcgatcgtgatgctgttatggcggaaatgggaatgggccggaaagtaaggatctttaatatacattgaaagtttccctaagcacgaaaaatatctggctccgtattcggcgagaattcctgaactacccactccgataaaaatgacgctttctgcatcggctgcaagggctgctgcttccttcagcttttcttccatccctccgcttactgttctttcaaaaaactcggcaacggaatgatggggactctttaaaatcgtttttttatttgcctccgcatacattttcagcttcaccttaaactccgaaaacccttcacagtttatttttttgcagaaacgtaaaatagaagccgtcgatacatgggtttcatttgccaattcacggattcgcatatagacgactttctcgctgttttgggagatgtagttgtataaagaagtttcaagctcgttaaatgaagcaatcatttcgtgtgtgaacatgcagggggattctcctttttatgagaatggtgaatgtacatctcatcgtaacatatcatttttaaaagaaacatagtgttatatttatgtgacaaatcactttttgtgtcattcaaaacaagacgtcagccaatgatttacggtgcaaaacaactgcggatataattcgttcatacgcttatgcatgatctcttcaagggtctctgacaaaagcggtcgaaaaaaggaggacaatatgagtatcaaactgatagcggttgatatggacggaacgtttttgaatgatgaaatggcatataacaaagagcgttttatgaatcagtatcgtgaattaaaagcgcggggaattaaatttgccgtagcaagcggaaaccaatatgcgcagcttacatccttctttccggaaatcaaaagtgaaatcgctttcgttgccgagaatggcgctttcgtcgtgaatgccggagaagaattattcgcgggtaacatgtctgaagacactataaaagaagtgatccgtgctttagagcagtatgaggtgaaaaacgtcattgtctgcggaaaaaaaagcgcgtatattcatgaaaatgccagtgaagatgaatatctgcatgccagtaagtattattatgtgttaaaaagggtgccgcattttgaaaacatcgatgatgacattttaaaattttccatcagttttcccgccgaacattgttccgcacttctgaggcatttaaaagacgccatcgggtctttcgtcacgcctgtatcaagcgggcacggtgacatagatctgatcataccggggcttcataaagcaagcgggattaagtttctccagaaacaatgggggataaatgatgaagaatgcgcggccttcggagacagcggcaatgatttggagatggtgtctgccgtgaaatacggagtcgctatggataatgcgcaggaaagcattaaacaggccgcggcgcatatcgcgcaatcaaacaatgaggaaggggtcttaaacgcgattgattccattctcaaatgtgaaaaaccctttgtctgaaaaaagacattttaactgcggaggtgctgaacgatgattaaattagtgattacggatttagacggcacatttttaaataatcaaggcgattttgacagaacgttatttgaaaagacaaaacgagtaatggaggaacagcatgtcgctttcgccatctgcaccgggaaacagtgtgaaagggtggaagccttattcggagaacacgcgaaagatttttggattttaggagacagtgccgcacgtatgaaaaagaacggcaaattcgtatatgaatctttgatcagcaataaagccgggctgtcaattataggcgctttagaaaaaatcagctgcgggcacaccattatcgcgtgcacaaaaaaaggcgcgatcgtaaaagaaaatctgtctgaaagtgaaatgaaatatgtaaatgcctcttatgcacatgtaacgaaaataactgattttactaagataaaagacgattttatcaagattacggttcatgaccccgacgccaactgtccggaaacgaaagaaaagctgcatgaattttttcaccaattatatatcgtagcatcagaagatacctggatggacatatcaaatatcggaatacataaaggatcaacagtacaagaactgcagcgattattaggggtttcggctgatgaaacaatggcattcggagacggccgcaatgacaaagaattgatggaagcggcatcctacagctttgcggttaagaacgccattgacgaaataaaagatgcggcgcactttgtcatcaaatcaaatgacgaaagcagcgtcatgcacacgattatgagaatattagcgctgcaaaaacaatgagaaagcagatcggctaaagccaatgcggcagggcttactaggaaaagaaaaagcgggctatcctccgactttaaatcactcctgattttccggaaatatgttaaaaatgaacaaatatctatatttgacccaattgtattggtataatatgtataaaatgaatgaaacggcgtaatatcaagatgaaataaatcacttcatatcatttgatatcagacaaaaagtaggaacttcctcgttttgaaattgggaggtgtttgtattagcccgctgttgagtcccgcgtatatcattctcatttttcttccggcagcttcttttctgttagggattttaggatatttcatcttcaaaaaagtatggatgatggttgttattgtattcattttgtccttgatatttatgtttattgtaataggtgccgaaccgacatttttcatttgggtggctatgatgacggggagctgttttatctccggttcaatcactaagacggtatggacttttgtaaagcgaaaatattagacactgaagaatcctgtttgaacagctatccttttttgccgattgaagaaatggaagtatagagtgatctgtttgttcttatattttgtctgttattgtattgtctgtctatcgttttgttcttttttaactaaacggagcactataattgaactgcagatacatagaaatacaaaaaaggataaggaggatttttatgtttcaaaccttagaccattttttgaaatcttgggaattcgaagccgatgcgacacaaaaactgctgaatcatctgactgatgaatcacttaaacaagaaatcacttcacaacattggactttaggccgtattgcatggcatactgtcgcggccattcatatcattacctcgaacacagatttaacgttccacgctccggctgaagattatcctgttcctgcgtcggcgcagtttattgctgagagttatcatcaagccagtaatgcatttgtgcaggcgttaaaaacgcaatggactgacgatacacttcaagaatgtgtcaactttattggtcagcaaatgccgaatggttcacttttgatgtttttaattcaacatcaaaaccatcatcgaggacaaatgactgtccttatgagacaagcaggtttacctgttccgggtatttatggtccggcaaaagaggaatggacaacatttggattggaagctccgaaataggatgttgttgtaagggctcgaacgaatagatgataccaatcgatgttggtatcttttttgttttagtcttcgtgacatgcagacgaatcaacagttcaaaaggtgtaaagtgagttcaataactgcagaaaggcgattatgatgataactaaaatgactcaattcaatatgaaagacttctataaaccaaacgaacctttcgttgtttcagggagaatcatcccttcatttgaaaacaatgtttggacatatacagaggagaaatttgctgaaccttatgtcaaaaaatatgacgatgaagacattgatgtcagttatattaaagaagcggataaagttgtctttttttattacgcagagaacgactgtgtcggccggagtatgcttcgttctaattggaatggatacgcactgattgaagacattgccgttgcaaaagattatagaaaaaatggtgtcgggacggctttattacataaagcgattgagtgggcaaaggagaatcatttatgcggtcttatgcttgaaacacaagatattaatgtttcagcttgtcatttttatgccaaaaataactttgtcataggagcggtcgatacaatgctttattccaatttttcaacagcaaatgaaattgcggttttttggtactgtaaattttaaatatacagtatttgatgtttcgtcatttagcgggtgtgtgccgcaaagtattcaaaacatcggcttgaggatttataataaggtatatcaatcactgcagggggagttatgtatgaagtgcaaaaaaatgaacagggtacaattaaaagagggaagcgtatcaatggccctataaactgcgtctgccctcattaatggagggaaatttgtgaatacgccttattcacagtcagctttacggcacaaccaagtgttcatttggctttgtgttttgtcatttttcagcgtattaaatgaaatggttttgaacgtctcgttacctgatatcgctaacgattttcataaactgccagcgagtgcaaactgggtgaacacggcttttatgttaacattttccatcggaactgctctgtatgggaagttatcagatcagctgggcatcaaaaaactgctcctatttggaattatggtaaatggcttcggatcgatcattggatttgtcggacactctttctttcctgtactcattctggcccgatttattcaaggggctggtgcagccgcattcccggctcttgtgatggttgcagtagtacgctatattccgaaagaaaacaggggtaaagcatttggtctgatcgggtcgctggtggcaatgggggaaggtgtcggaccagctattggcggaatgatcgctcattatattcactggtcatatttgctgcttattccgacagcaacagttatcaccgttccattcctgatgaaactgctggaaaaggaagaaagaatcagcgggcgctttgatatgacggggattatattaatgtctgcaggcaccgtattttttctgctgtttacaacgtcatatagaatgtcttttctgatcatcagtattctggctttcctgatatttgtgaaacatattaggaaaactcaagatccctttgttgaccctgcactggggaaaaatgttttgtttataatgggcgtcctttgcggaggcctgatattcggcactgctgcaggatttgtgtctatggttccttatatgatgaaagatgttcaccatttaagtactgcggcaattggaagcgggattatgttccccgggacgatgagcgtcatcatcttcggttacattggaggattgcttgttgatcggaaaggttctttgtatgtgctgaccattgggattgtattgatgtcttccagctttttaatcgctgcctttttcatagatgcggcaccttggcttatgaccgtcataatcgtttttgtttttggggggctctccttcacaaaaacggttatatctacaattgtgtctggcagtttgaaacaaaaggaagccggcgccggaatgagtctgcttaattttacgagctttttatcagagggaacgggtatttcgattgcaggcggtttattatcgatcagcttgctgaatcaaaggctgctgcctgttaacgctgatcattccgcttatttgtacagtaatatgctcattctttttacaggaatcgttgttatgagctggctggtgaccatgaatgtctataaacgttcgcgaagaaatgactaaaaagggaaaaggatcaaacttgataaaagttttgatcctttttttaaggagcttccttattacggaaccttttgccgatcaatgaaaggggagttaaagtgaattacatttataagaaaaaggaaaagaaaaatggaaaattgtatcatttcaatcagagataaatgggagaatgcacttattgggtctgaacaaaaaaataatcaaattgagatcgtaatcaattaccgcaacgagaaaacaaccaagtttttactgccaatcgagacttttgaaaaagtgtatgaggatattaaaataggccggagagaaagttaatcactgtttgaaaatgactatgaagttcgtaagcggtatggttttaaccgcatctggattcccctggcaaagtaaaggtttttggggatttatgtcaaaataatagtaagtatcttatgcaacagggagtttggttgcttcataaggaggggaagtatgaaaaataagattcacatattgggagcctctggtgtcggaacgtcaacattgggtgttgcattatcaaagcatttgccgcatacgcatcttgatactgatgattactattggacagataaattcactaaaaaaagagaaatccctgaaagaagaaagttgcttgaaaaagacttgacaataaatgagaaatggattctttctggcgcagtgtgccgctggggcgatgatctaaaaagttattttgaccttgtcatcttcttatggattccgcaggatatacggcttgagagattaaggcatagggaatttcagcgttatggaaacgaagtgttagccggcggcagtaaatatgaacaatcaaaaacatttttagagtgggcttctttatatgatcatgccggaatggaagttagaagcaaagctttacacgaacattggatggcggatttatcttgtccattgttaaaaattgaaggagattactcagtcaatgaaagagttgatcgtgtcttggattatctgaattctaattaaactaacggatggagataactgcaaattgaaagacagttccggccattttaacggagctgtttttttataccgccttcagtttgtctgttgtgaagtgatttatttccggaaagaagcagcggaattaatagagaactcacttcgggaaaccgtgaaggcagaaatcaaaacgggagacttggcggtcaatcatcaacgtcagactttggggaagaattgcagaaatgatcggacgttaaggcggaaaataagaagtgagaagcagatcatcaaaacgcaatacacctcaatttatattttcagtaagaacggctctgctcattaaaaaactcaattcaaagattagtggcatcaatattgccgcagatcgggttagtgacataagaggaagggataagaccccttccttaaaacctttaattcctctaatttcattgtcagatatattccttttttgaaatgggtatccaaatttcacttttaaaagatggcgatgttacatccttatgctcgttccacaggatttctgggccttcaatttgttcataatgtgacgatggaaaccattcggaataaatccgcccccatacttcctgcagtgcatccggaaatgatccggctgcttcgaatacagcccatgttgaggcagggacttcaagctgtgataggtgatttgggcaatgtttcgttgtggctgcgccaatatagtgatcaagctctccgttttcctctgtccggccttcagaaaagttcgtggatgcactgatgagccctgcaggcgctgtattagaaagctcttttagttgtttgattgctgcttcatctaaactttcccacatcgatgcaatgtcaggattcacgcctttgaacaaaatagggactctttttttaatgccgacgatgcgaaatgcctctttttcttcaatgcgatagttcatttcatttcctcctttgattgataactggaaggtcattcgcggataagctttaagtgaatggccattatgtttagcttctgatgggtttatgccatgcagattttgaaatgctcgtgcgaaagaatctggtgagtgataaccgtattttattgcaagatcaatcacctttacgcttctgtctttaagttcaaaagctgcaagagtaagacgtctgcggcgaatatattccgataatgaaatacctgtaaggaaggaaaacatccttttaaaatgatattcagagcagaaagcaagccttgctgcttctttgaaatcaatagcgttcgtgaggttttcttcaatatacattaatgcgctgttcatccttttaagcgaatccatttatttgacctcctttaacaaaagaataacaggagcgaaatgtatctgcccgacatttcgtgcacagttttgcaggataacttatatgtaataaattaagttactcacctgtatttgtacagataaagaaaacacctaataactgcttgggtttcataagatgaaagaaagttatcattgttttatattgaaaagaaaatagaaaaagacggagttttcttgcgggaggggtttactatcaatcaattgaaagctgcatacgcggaggcagttaaaaaattttagttgatgtcgagaacgatgttcatcttcattgcttgttcaattagaggaagtgattcttccttaagggagatcactttttttattcgactaaagcagcagtttagcggaagaaggagaaaaatcagttgacttacttgatactgaataggtggtgaaaagtggttattcatacggattgaaaaagaagaacgcgcagcagattcacttgctcttgttgggggcaagtgttgacaaccctattagctggtttaattaaagaaggggtataaaacctgtatcaatgtgttactagatatctgcgacacaggttttatatgtaggtaactaatattcttatatatgcaacattgcattttttattatgcaatagttcactctatttctgctttcaatttttcgaaccactctaaattaaccaagtgatgtgaacgggaattttcgttcatacggcgaaagtaattgattgtgccgggaatttcttgagtggtggacaggtattcatcaaggagctcgattcgagttttagtctgatcgatttgtgattggatcagatccagtaatttatttttgtcgatttcatcggcaaagagtaacgccccataaaattgcaggttcacatattccgatttggtgccgtatttgatcattaatttttcaaattctgcccttcccgaatctgtgacgttaaagttacggatttcacgcccgctggttgagggtttctgctgaatctgttcaatcaaacacttttcttcaagttgctgcagattgtaataaaatgaaccttttgtgaagttaacaatgtatttgtaatgacgtttttccattaaggccagaagttcatagccgtgagctccggggttttggatgagcaagccaaggataagtaagggaatcatggtttcatcaccttcgccatccgcgcctcaaattccgcgtacgtgattttacccgaagccaaatccatactatgaaggtaaatctgttctgttttagaatagtcaccattcactttcagtgattgctcctctcccgaaatgggtttcaggatatggtgctttttcgaaaaagcctcgaaatagcggtaaccgaatttgcgttgtgaagctgcgtctaaatgaatgccatcaggattcgcagtcaaacctgccgcagtaacaaaataacaattctgttgttcattagcaaaacgcagcaattgttcattaacctgtcgaaattcagtcgcgtgctgtccaaaaccggtcttcccaagaaagtcaccaagccctccaataatcaacggtacctcatcaagtttcaactcgtttcttagcgtctcaatgataagagttaatttctcgtaataagtttcatgcagcgaacgataactgtcactctcaccttggtgccaaaggattccgcaaatttgactggaacggagggcgaagcgggcttcggacaaagcatgctgaaaaaggatgccttccggatgccagtcattcaatgaactgccgccttccgcacacgggatcaagccaatttcttcatcgggatgagctttcgaccaagcatctgcaaaagatgccgccaagccaacgccggaaaccggacggtcgtaattaatcggctctgtcatcatctgccactgtccattgcgcagcatttttattttttcattatagatagggtctacttcattcaaaaatccacggcccgccatattcgactgccccaacattaaaaaagactttatcatttaatttttcacttctttacatcaatattttagtctaattagactatagtcaattcagcttgtcttgtaaagttctaataaggtcttacttttattagtagtatgtatgaaaagcaaactaacattgaaaatttggtggatgtatttgagaaatagcaagttcttttgctttagatcttgataaacaatgaaaaacaacaaaaaccctgtcatgtaagggttcctatgaggttcaaaatcatttttcatagaaaatacattcaatgatgggggtgagcccaaatgaaatggattgttaaaaagggagggctgtgttgaaggggttaaatatcaataaaaaatcattgaaaatgttaacgattgtaccaattctattcatttgttatgttttacttttaaatcctgaagttatacttgaagaggaatgtcctaaaatgcagaaaaagccggaatgtcagatccggcttttcgctcactttcccttcttcttccgcttctccttttccgcccgataaaactcatggaacatcttcatcaatgcgcgtttttcaatccgcgacacataactccttgaaatgccgagctcctttgcgatctcgcgctgcgttttttctttttttaaatcaagcccgaagcggccgacgatgacttctttttcgcggtcgtctaaaatatcgatatattttttgaccttttcaagttccatgttgagctgaatggtgtcgatcacatcctcgctttccgacttgaggacatcgatcaggcttatttcattcccttctttatcctggccgatcggatcatgaagggagacgtcttttttcgtttttttcaatgcgcgcagatgcattaaaatctcattttcaatacatcgtgcggcatatgtggcaagcttcgtgccttttccggctgagtagctttcaattcctttgatcagcccgattgtaccgatggagatcagatcttctgcgtcctctcccgtattttcgaattttttcacaatatgggcgactaaacggagattatgttcgatcagcatattgcgggcgtgttcatctccttcagccataaggtctaagtattttttctcctcactatttgagagcggttgtggaaaggcattatttttcacgtatgatactaaaaacacgagttctttcacaataaacccgagcgctgcaaaaacacctgtcaccatcctcacctccacaaagttatgtaggcaaaagcctatatgtaactgtatgtggcagtcaggctgtttgtgtctgtacagggaaattaatcaaaggcaggttttatttcttacagcctcttgatttttgctgattgagcctgtatattgttaaaaaaagtaagggtgaaaagaatataacgaaaagcgctgaagagacgagtagacagatatcattcatgacagagagctccgggagctgtgaaggagtatgaatggatgtgttgaaacaaacctcttagcttcgcatcggaatcatgaaaaacgaggatgatgcggcggatactcctgttaccgagtaagctttgtacccggcaagaggccggcaccaaaccgaattgaggtggcatagcgggctgtttcccgtcctcaagactttattgtcttgagggcgttttttatttctaagggagggataagatgaaaaacctgaagtcttggcggtacccgatgcttctgttaaccggaatcgggatagcaaatattggtgaatggatttattttttgtctcttaatcttattgttttaaaagaaacggggtctgcttttgcggtttccatcctttatttaatcaggcctgcggctgttttgatgacaaatgggtgggcgggcagcatcatcgacaggtgtaacaaacggaatatgatgatgtcgcttgatttcatccgggctgcattcattgccgttctgccgctgatgtttactgtaaggtctttatttttcatttattgtatcgtgtttttgattcaaatggccaatgcgatgtttcgtccgtgttccatggcgtatgtgacgatgcttattccggctgaaaggagaaaacgattcaattcactaagggctttgtcggaatcaggggcttttctcctcgggccggctgcggccgggctgctttttatcgccggcacgccgatttttgcgatttgggtgaatgcggcggctttagtgctgtccggtttcatcacgatgatgctgccgaaccttgaaaatgagccccacgtacattctcccgcacggaagctttctttggcagtgtacaaagaagattggaagctcgtctatcgcttcagccgaacggcgcgaaatgtcatgatcatttattttttattcagtctggtcatgaccgttatgccatccgcgcttgattcgcttgaagccgctttttcaaaagaagttcttcagctgactgatgccgattacggttttcttgtcagtgtctcaggggcaggcattattgcgggggcgcttgtcaacgtaatctttaataaaaaaatgccggcttctttattgatgggaatgggctctttattcacagcggccggatatatgatttatgcgttttctgacgttttttggacggctgctttcggatttttccttctcgctttttttctggcgtttgccaatacaggctttctgacgttttatcaaaagaatgttccggtggacatcatggggagagtggggagcttttattcattagtcgaagccgtcttcattatattggtaacggcggttttcggagcggcggctgtcggttcttccgtccgcgtcatcgtcatcgcaggggctgctgttatgctggcgttggcagccgttttatgctcgttcttatttgcggcctcaaaaaggaggactcccgatgtgtttcaagcggatcaatttaaagaaacataaagagacggccgtttcatttcgtgaggatgagtatctcaggtggctgtcatcccaaatctaatgctcacccgacaattttaagctgcttcttcataacgggcagccgatcggacagcttgaagcttccatcaacttttaccgcagccaaaaaatcggttatgtgcacctttactgagcagcaaagagaacgcggaacgaagctgcatcaatttagaattaaacggaaaagttctcagaatgagaggagccgtaccgccggaataggaggcggtacgcgcttcattttttcgttgtttttaaaagaccgggaaacttcttataaatgaccgccattaagacgagcatatacattccgtaaatcccgaaagacagcagtttgttgcttgtaaatgaagcgcctgcgacggtcacgatcacaatgttcggaattttgccgagcaccgacgcagaaaaaaagatcggccatcgtatattactcagcccgcagacggtattcatggcaagcgacggtataatcggaatgagccgcccgaaaagcaccgccgtaaacgcgtgctgatgaaatgaaccttcatattgagccgcggccgggtaagccaccagtttttttctggcccagtctctgaatccgtaccggacgagaaaaaacaatgccattgttccgagcattgcgcctgacaatgtaatccacactccgtttacaatcccgaaaaccgctccgtttaaggccgcgataatggcgaatggaacgatcggaaaaaatacgtcagctgcgaccagaaggatactcataagcacggcgtacatgccgcccgcgcgaatcatgctgagccagacgtctttttgcataaagccgatcatcacgacagcaatgatgacggcaagactgaatcccttttttatcatctgtacgttcacctcttttcaattagtatacagcacaaatctatctccttctattaaaataagctgtccgataagcgtacttgtttatcagcatttgccgtttgatgagaaacgactggcagccgggtttggacaaaaacaggcgggaagcgggtgatgtgcatcatttgatgcagagaatgattttatacaaaaggggacacgttaacagtagtgtttactggaggtgtaaacgttgagatgctttcatctgatcatcatgatatgcgtcctcacgggtctcactgccgtgtccgccgatgcgaaatctttaaaaagaagtgacatggagaagacgggaaacgtgtactgggatataaggtctgaaaaaaagaagctatctttaaccttcgatgacggcccccatcctgtctatacggaggctgtgttagacgtgctgaaacagcacaatgttaaagcaacctttttttgtatcgggagccgtatagacaaataccccgtaacggcaaaacgcatcgttgaagaagggcatgaaatcggcaaccatacgatgaaccatgtttattttcaccgtttaaaacgcaaagacattttacaagagcttcacagctccgcgcatcatatcagatcgctgcagccggaaggggacaagttattccgcccgccgggagggtcgctgaatcatacggctttcaaaagcctcttaaaagagggctatcatatcatcatgtggtcatggaaccaagatccgagagactggaaaaggcccggaaaaggaaaaatcgtcaggcacgttgtttcacatgccagagatggagatatcgttcttctgcatgacggcggaggaaaccggcgccagacggttgaggctttgaaagaaatcattccccagctgaaaaagcagggctacacgtttgttaaggtttcggatttgatcggacaggattccggtccttttcatatccagtaaagagagcgccgcgttgaaagccgccaaagagatgtgtaccataggaggtaaggtttggggggagagaaaatgaagtttgctgttctttttattacgataacctgtctgttatcaggatgcgctgcgggcaaagagaaaagtgttgtcgcgttcggcgacagcaatacgcgcggttccaactgggattatcgtgattatccgaaggcgcagcagtgggtaaacattttaaaaacagcggaacgcggccgtcttacggttataaatgcgggaataggcggccagacgactgaggatgcgcgcctgcgctttcaaagcgacgtgctggagcgtaagccccaatatttatttatcatgttcggaacaaatgatgcgggcattttgacgggagatcagccgcgagtatcaaagaaacggtttaaagaaaacctgacttatttcataaacgaaagcagaaatcacggcataaagccgattttaatgacgtgcatcccggttatagaaggaaacggaacgcatcatctctattactattcgagatataaagcctcagcctttaaagaaaaaggcggcgcgagaacatggcataattcctataacggcgttacgaggcaggttgcagctgagttgaaagtgccgctggtggataactggaaacactttatacgcgcggacggaggcaaagatacagaccgggcgctgatccaatccggactgatagatccctccggaaatcatatgacgccaaaaggcgccagaatcttaattgaaggcataaaaaatgggcgggttttggaacgctgacgccgtcagctgcctaaaccgttttgcttctgcttcataggctgtagaaaaaacatcttttggaggcgattgctatgaaccgcggtttccctccgcaatatcctgtatgcccgcctcctcgggtgaatgcggggtactggtacgcattttttgttgtgctgctcgtcgtcattctcgttctgggcggtctgtattggttcaatatatagcagccgtcctcttaaacacctctattttaggggtgttttttgttgaaagtggtagtaatgcgcataaccgaagtgatataatatcagtcatctgagtaaaaaaaggaaattcgcccgggaattttttctgtttaagaagaaacggaaataatgtgtccgagcgatcttcttttgatttcgttttcaattaactcgataaattcacggctcaaattcatttcattggctttgaaataagattctattagtaattcatcagagagctttctcatgccggggacccaattaatgggagtggcacctccttacaattgtaatcaatcatcagacgcaagcatatgatggaaggttgcgtttcaatcatggtgaggttatctttaatctaccatgaaatacaaataagaacaatcgttctgttatccacactcgtaagtggataacttgttagtatcttgtttataatctggataaatccggatgtaataagagtggataatgtgtgtaattttatccacaactggtgaagaaacccaatttttgtcgaaatttttttaccgagtccgactttgtttttaaatctgacaggtttcgacatatagatgatagaaagaaaaggaagggtgcgggttttgttaaaaaagttttttttacctgacgaatttgtgaaaaatatatttcatatcacaccggaaaagctcaaggaacgcaatgtgaaagggattattacagaccttgacaacacgcttgtggagtgggacagaccgagtgcgacacctcgattaatcgagtggtttgaagaaatgaaggagcacggcattaaagtcacgatcgtctccaataataatgaacgaagagtgaaattattctcggagccgcttggcataccgtttatttataaggcaagaaaaccgatggggcgcgcctttaaaagagccgtcagcagcatggagctgaaaaaagaagactgtgtggtcatcggcgatcagctgcttactgatgttctcggcggaaacagaaacgggtatcatacgatcctcgtcgtgcctgtcgcttcctctgacggagtcatgacgcgctttaaccgccggattgaacggagaatattgagttctttgaaacgtaaaggccatattcagtgggaggattaggaatggaaaaggttgtttgcatcggctgcggagtaacgatccagaccgaggataaacaaggtctcggatacgcgccaaaggcatcgctcacgaaggagaatgtcatttgtcagcgctgcttcagactgaaaaattacaatgaaattcaagatgtttcattaacggatgatgactttttaaatatcttgcacacaatcggcgatactgactctctaattgtcaaagtcgttgatatttttgattttaacggaagctggataaacgggctgaaccgctttgtcggcggtaatccgatcattcttgtcggtaataaggccgatatcctgccgaaatccgtaaagcgggaacggctcgtccaatggatgaaacgcgaagcgaaagaatacggcttaaaaccccttgatgtctttttaatcagcgcttcccgcggacaagggatgaaggaagtcattgacgccattgaacattaccgcgaagggcgcgatgtgtatgtggtggggtgtaccaatgtcggcaaatccacatttatcaaccggattattaaagaggtctcaggggaagagaatattattaccacctctcaatttccgggcacgacgcttgatgcgattgaaatcccgcttgatgacggatctgcgctttatgatacgccgggaatcattaaccatcaccagatggcgcattacgtggacaagcgtgacttaaaggtgctgacaccgaaaaaagaactgaagccgcgcacttttcagctgaatgaaaaacaaacgctttatttcggcgggcttgcccggtttgactatgtatcaggcgataaaacggcgtttgtatgctatatgccgaatgaattgatgattcacagaacaaagcttgaaaatgctgatgccttatacgaaaagcatgcgggagaactgcttaccccgcccggaaaagatcatttggatgaatttccggagcttacggcccacacgtttacgattaaagaaggaaagacggatatcgttttttccggactcggctgggtcacggtgcagcaagcagataaaaaaataacggcatacgctccgaaaggcgtacacgtatttgtccgccgttcattaatatagagagaaggggagagggagcatgaaacaattgtacggagtaatcggaaatccgatcgggcattcaatgtcacccgatattcataacgcggctttgcaagataagaacatcaacgggcagtattttgcgtttcaggtggaacctcatcatctcaaggacgccgttaacggaatcaaggcgcttggcatctgcggagtgaacgtcacagtcccgcataaagtcgcgatcatggagcatctggatgaaatacatgaaagcgcgaaagtactcggggccgtaaataccgtcaaaagagagggagacaggctcatcgggtataatactgacggagatgggttttataaatccttagtcaaagtattggacaaaccgatatcagagctctccatcctcatgattggggcgggaggggcggcaagagcgatttttacgacgatcgtccgcagagagccgaaacaatttgacgtttgcaaccgcacgccggaaaaagcggaaagtctgattgcggctgctccctcttttcagcagaaacgcgcccttactttaaaagaagctgaaaatcagcttgaacaatatgacgtcattattcatacaacatctgtcggcatgtatccgaaaacggatgccgtgccgctctcattggaacgggccaaaacgggcgccatcgtttgtgatatcgtatacaacccgattcaaacggcgttcttaaaagaagctgaaaaaagaggtttaacaacccttgacggtgtcggcatgtttgtggaacaggctgcactgtctttcaagctgtggacggaacaagagcctgacagcggcttaatgagagcaattgttgaaggaaaactaggaggaacacaatgttaacaggaaaacaaaaacggtttttgcgttcaaaggcgcatcatttaacgcctatttttcaagtgggaaaaggcggagtcaacgaaaacatggtgaaacagattgcagaggctttagaagcaagagagctgattaaagtcagcgtgcttcaaaactgcgaagacgataaaaacgatgtcgcagaagcgcttgtgaaaggcagccgctcacaattggtgcagacgatcggaaatacgatcgtattgtataaggaatcaaaggaaaataaacaaatcgagcttccgtaaggtggttgacatgaagaaaatcggaatattcgggggcacatttgaccctccgcacaacggacatcttctgatggctaatgaagtccttcatcaggcggagctcgatgagatttggtttatgcccaataaaatcccgccgcataagcagaatgaagactttacagacagccggcaccgggtggagatgctgaagcttgccatcagctctaattccttctttaagcttgagcttgcggaaatggaccggaaaggcccttcttatacctatgataccgtccgtttactgaaggagcggcacccgaacgacaagcttttctttattatcggggcggatatgattgaatatctgccgaaatggtacaaattggacgaactgctcacgctcattcaatttatcggagtgcggcgcccggggtatcatatcgagaccccgtaccctctgctttttgccgacgttccggaatttgacgtttcgtcaacgatgcttagagaacgtctcaaagcaaaaaagccgacgcaatacttaatgccggataaagtgaggcagtatatagaggagaatgatttatatgaatcgtgaggaagcacttgcctgcgtcaaagaacagctgaccgagcatcgctacatccacacaatcggcgtgacagatacggcggttattctcgcaggccggttcggagcagatccgaaaaaagcggaaatggcggctatttttcatgattatgcgaaattccggccgaaagaagaaatgaagcagatcatcgtgcgggaaaaaatgccggctgagctcttggattacaatgccgagctgtggcatgcccctgtgggagcgtatttggctgagaaagaagcggggatcactgatcccgagatcttggatgcaatccgctatcacacgtcagggcgtcccggaatgacccttttagacaaagtcatctacgttgcggattacattgaacccggccgccattttcccggagtggaagaggtgcgccgtctggcggaaacagatctgaacgaagcgctcatacaagcgatgaaaaatacaatgatatttctgatgaaaaaaaaccagccggtctttccggagacgtttgcaacctataactggctggtgtctcaaaaacgacaggaggaatatggaaaatgaatcaagcttccgtattaaaaatcgcggcaaaagcatgcgacgataaacgtgcagaagatattttagcgctggacatggaaggaatctcacttgtagcggattactttttaatctgccacgggaattctgataaacaggttcaggccattgcgcgcgaaattaaagatcaggcagaagaaaacggcattgatgtcaaaaagatggaagggtttgatgaggcccgctgggttttagttgatctcggcgacgtcattgtccacgttttccataaagatgaaagaagctactataatcttgaaaagctatggggcgacgcgccgctcgcagagcttgaactcggcttaaactcatgatttaccaaggcttcgccggtgtatatgacgagttaatgtcccatgcgccgtatgatgaatgggcgggctggatcgaagcgtctcttccggaaaagggaagggtgcttgatcttgcctgcggaaccggagaaatatccatcaggcttgctgaaaagggctgcgaagtcacggggattgatttgagtgaagatatgctgagctgtgcccagcagaaaaaaacaggaaagccgattctttttctccagcaggatatgagagagctttccggttttgaagaacagtttgatgccgtagtcatctgctgtgattccctaaattacttaaaaacgaaaaatgatgtcttaagcaccttcaaaagtgtttttcaagttttgaaggagggcggcctgcttctgtttgacgtccattccccgtataaaatgacggagctttttccggacagcacccatgcggatcaggatgagcagatcagctatatctggcaaagctttgccggcgatgaagagctttctgtcatccatgatatgtcctttttcgtatggaacggacaatcttatgaccgctatgacgagacgcatgagcaaaaaacattttacattgaagaatataaacaaatgcttgcagagaccggatttgaattgaagaaagtgacggctgattttacagaccggcctccttcaacagagtctgaacgtcttttctttacggcaggcaaaccaaaaaccatcgtttaaacggaacgatggtttttaaaatgcattttttgcgattggcgcgataaagctctttatggcatactcagttacacgtgaaattgcttcttcactaacgatatatcttcatcgtatttgtcatgtgtacgctgaaagacacgattgaacatatcctgaacaccgctttcgagagccttcagtccttctccggtgacgccgccttttacgcatactttttcctgcaaggcgggaagcgtgtaatgccccgtttcaagaagctttccgagaccgacaagcatttctgtcgacataatcacggcttcttctttggtgatgtccgtttcttccactgccgcgtcaataaagcgctgaacgagataactcataaaagcgggcccgcagctgacaatgtctgacgccgctcttgtaatgccgctgctgatttccacaggttttgaaatatgagtgaacagcgtttgaatatccgcttttgcagactcgctgcagcttttgccgaacgtaacaagcgagacgccggccaaggcgcggttcgtaatgctcggaatgacgcgggccgtctgacacggaaccgtatgttcaatctgatccgtctgaacggggctggtaatggatattaaaatgtgatctttccgtaaatgctgtgtgagttttttcagcaaaggatatatatccagcggttttacacaaatgaatatgatttcattatcctgtactagcttttcctgatcctcggtgacgtggatgccgctgaaacgttcttttagttttaatgctttttcgattgttctgtttgtgatggtgatatgtgagggatcggcagcgtttgattcgataaacgattcaatcaggatcgttcccatgtttccggtgccgataaagcctattttcaatgaattcccctcctttttcccttaatcctctaaaccttatgcggggaggcaatgcaatatgacgaaagcgatgatgacggagcggatgcggcggaacctgaaaattctgggcgcttgtcttgcggcaggggcagtttttatctgtatttggctgtttcgttctgaaaaggaagagccggtcaaacagcagtccgtgctcggtcaaacagcctccgcatccgtcgcggacaaaaaagacaccgcagacgataagattatgattgatgtgaaaggagcggtccgaaatcccggcgtgtatgaaatgaaagcgggagacagagtgacgcaagccattgaaaaagccggcggcctgaagaaaaaggcggatgaattgaatgttaatttagcagagcagctgcaggacgggacgattgtttatattccgagtgaaggcgaagaggggaatcatccgaaaacagcagttggtgaaaaggagaatgcagctgtcaatatcaatacggcatctctggacgaacttcaggcgatttccggggtggggcagaaaaaagcggaagccattatcgcctaccgagaagaaaacggacggtttcagactgctgaagatttgatgaagatatcaggctttggagaaaagtcatttgagcggataaaaacttccattacggtaaagtgaattgacggttctgcttaaatctatgtaaacttagaaaagcaacaagactttttggagggaacacttgtggaacgaatctcatggaatcaatattttatggcgcaaagccatttgctggcgctgagaagcacatgtccgagactgtcagtcggggcaaccgtagtcagagataagcggatgattgccggcggatacaacggctcaatcgccggcggcgtccattgcgctgatgaaggatgccttttaatagataatcattgccagaggaccatacatgcagagatgaatgcgattctgcaatgttctaagttcggtgttccgacggagggcgccgaaatttatgtgacacattatccttgtattcaatgctgcaaatcaattatccaggcaggcatcaaaacggtctattatgccgaagattacaaaacacagccttatgcaaaagagctgttcagccaagccggagtcaaggtggagcaggtcgaacttgatgaaatgatcatcgatctgaaaaaccgcgaaaaattgtcttttgtcgcaggtctgattcagcaattatctgatgcgggagttaaggcagatgaactgaaaaaaattcatgaacaggccaatgagctgtttaccagttacgtataaatgaaatataaataccttcttctgcctctggcggcggtttctgcaactgcgggaattgccgccgctcatgtcttctgggttctgctcctttttcttctgtatcttctctttattatgataaaaacaaagcagcctgctccggttgttgtctgcctcgtttctttttgtgtttatttctttctttatacggtttgtgacgctgcgaatgtaacgcggtatcaggccggcagttatactgaacaggccgtcatcactaatattccgaaggttgacggagcgaaaatgtcagccgttatccgtacacatgacaaggaaaaatgggcggcttcgtacaaaatccggtctcttgaggaaaagagactcattgaacagcttgaaccggggatgcgctgcacgtttacaggctctctggaacagcctgcacatgcgacgattcccgggggttttgattataaggaatatctttactctcagcagattcactggttatttaccgtgacttctattcagcagtgtgaaaaatccaaacagccgctgtttaaactgctgagcatcagaaaaaatttgatttcgatcattcggaatcacgtgcctgaatcttccgccggaattgttgaagcgctgaccttaggtgaaagattttctatagaagacgatatactgagtgcatatcaaaatttgggagtcgttcatttaatggcgatttccggaatgcatgtcggtcttattacggcgggactattttatgctctgatcagaatcgggctgacaagagaaaaggcggggatgttgctgctgctgtttttgccggtctatacgctgctgagcggtgccgccccatccgtattgcgcgcatccctcatgctgggattttatatcgccggaactcttgttaaacgcggcattcattcctctgctgcattgtctctgtcttatctgctgctcctgctgtttaatccttacctcctttggcaggcgggcttccagctttcctttgcggtaagcgcctctttaattctgtcatcctccattttaaagaaagcagggaaaagcagacttgccgggcttgcgatggcctcattcatcgcagagctcagctcacttccgtttcttctctatcattttcagcaaatttcacttgtcagttttccgatgaatatggtgatggtgccattttatacgttatttgtcattccggtttctgtcatcggtttccttcttcttttactttcaaggcagatgggagaatgtttgtttaatatgtttgaccttgtgatgaagcctgtgcatgatttcattacatatgcggcatccgttgatttatttactatgattgtgttaaagcctgactttctttcccttcttctgcttgcggtttccgtttttacgctttttgcggctttagaaaagggaggttttttaaaactcaggaaatcggctctttttttctgcgcggttttggcttatttaatatgccgtccgtatttcagcccatggggagaagcggatatgcttgatatcgggcagggagactcgctgtttataagcgcgccgcaccgcaaagggaccgtaatggttgatacagggggagtgattgcttatcccggagaatcatggaaagaaaaacgccacccgtattctatcggcgagaaggttttgattccgtttttaaacggaaaaggggtgaaaaagctggatgcgctgattttaacccatgcggatcaggatcacatcggggaagccggagtgttaatcaaaaatcatagagtcaaacggttaattgtccccgtgggattcgtaaaagaaccgaaggatcagaacatattaaatatggcgaaagaaaacaacattcccgttgccgaagcaaagcggggcgacaccattacagccggtgatcttcagtttcaggtgctgtctccggagtcgtctgacggaaagagtaaaaatgattcgtcactggtgctttggacggttttaggcggagtgagctggcttttgacgggagatttagaatcggacggcgaaacagaagtgctgaaaacgtatccgaaactgaaggctgatatattgaaggcgggtcatcacggcagcaaaagctcaacgggtgaagcctttttgaaacagcttcagccggaagcagcgctgatttcagcaggaaaagagaatcgataccatcatccgcacgaagaagtgctggatcgtttgaaggcgtactctgtcaatgtgcttcgcaccgatatcagcggaacgattcaatacagatttgaaaaaggcgccggaacgttttccgtcttccctccatatgatatagaagaaaccagggcgcaagaagtaaaaaagactgccgattgacagcagcccggaatgcggctaagagccgataagatggatggctgttgccatcacgaacaaaaaggcgaaaaatccgaaggacacgacaaaaccgacagctgagtcaacagcatcatttcgtttgctttgaacgtttttttcaaaatcattcaatttcatccctcctgacttccctaagtatactggaattgttttgaaaaatctagaagtgatggtaacgttttctgttcttgtgattatcgcctttttacaagcagacccgggagcttgtgaatcaggcgtttattataaatgaggaagctgtcctttttaaagcttcctctttactatttgccgaactcaatttaggatagaaggggatcaagaaagagaggaagtcatacgatcatggtatttgatgtttggaaagccctgaaaaaaggggatgtccgctccgtttattgcttatacggaaaagaaacgtatctgctccaagagactgtcagccggatcagacaagctgtcgttgatgaggagactaaagattttaacctgtctgtttttgatcttgaagaggatccgcttgaccaggccataaccgatgcggaaacgtttccgtttatgggagagaagcggctggttatcgtaaaaaatccgtcttttttaacaggggaaaaaaagaaagaaaaaatagagcataatacaagcgctttggagacttacctgaaggagcctgcgccttatacggtctttgtgattgtggctccgtatgaaaagctggacgaacggaaaaagctgacgaaagcgctgaagcaaaaagcccttatgattgaagctaaggagctgaatgcaaaggagactgctgattttacgattaatctggcgaaatccgaaaataaaacgatggatacagaagctgccgagcatttggttctgcttgcaaacggccatctgtcttccatatatcaggaaatacaaaaactctccgcctacaccggtgacagacatgagatcacgcttgaagatgtccgggagcttgtcgcaagaagtttggagcagaatatttttgagctgatcaacaaaatcgtgaaccgaaaacggacggaaagtcttcaaatattttatgatcttttaaaacaaaacgaagaaccgatcaaaattatggcgctgatcgccaaccaattccgtctgattatgcagacaaagtattttgcgggacaaggatacggccaaaagcaaatcgcttccaacttaaaggtgcaccccttccgggtaaagctggcgatggatcaggcgaggctattttctgaagaagagctgcggcgtattatagaaaggctcgcagtaatggattatgaaatgaaaacggggaaaaaggacaagcagctcttgctggagctctttctccttgagcttctccggactgaatgaaaaaaacgatccccgttaaagggatcgtttttgtattatgcagaaagtccgttcacttgtttcgcaagtctagatttgtatcgagctgcggcatttttgtgtacaagacctgttttcactgctttatcaatgcgtttcgctgcttcagaaagagcagttttcgctttatccgcttcgttgttagcaacagaagcttcaacttgtttgattgcagtacgcatagcagatttgattgtcgcgttatgagcgcggcgttcgttgtttgtttttgtacgtttaatcgctgatttaatgtttggcatgtgtttcacctcctaagatacaacctgtagcacagtgtcttaaggttaaatcttcttcacaatagaacaaattgtattctatcaaacagaactttagattgcaatataaatgtaaagtatttttcgttgatgggtaaattcgcatgattcgttttgtaaatggccacactatgtaccacgatgattgaaggaggtctttcctgtgaaaaacaatgaactggatgtcaatcaatttctgatacggacggatttagcggtagaaacgaaacaggcggtaaaagacggacaagccggtcagacaaaagaaataaacgggtttattgaaaaagaacgcgacaagggcggcattaaagtcagaaccgtcgatattaccaaagaaggcgccgagctatcggggaaaaagcagggacgctatgtcacgatcgaggctcaaggtgttcgggaacacgactctgacatgcaggaaaaagtaacggaagtgtttgccgaggaattttccgcctatctgtcggcattaaagattccaaaggatgcaagctgtttgatcgtcggtctcggcaactggaatgtgacgccggatgcgctcggccctcttgtgaccgaaaaccttcttgtgacaaggcatctgttcaggcttcagccggaaaacgtgcaggaagggtacaggccggtcagcgcgcttgctcccggtgtgatgggattaacgggaattgaaacgagcgatattattcaaggtgtgatcaaagaatcaaagccggattttgtgattgcggtagatgctcttgcggcaagagccgttgaaagggtgaacacgaccatccaattttctgatacgggcattcacccgggatcaggcgtcggcaataaaagaaaagaattaagcaaggaaacgctcggcatccccgtcatcgcaatcggggtaccgactgtcgttgatgcggttacgatcgcgagcgatacggtggattatatattaaagcatttcggcagagagatgaaagatgacagcccgtcaagatctctggtgcccgccggaatgaacttcggcaaaaagaaggtgctgacagacgaagaccttcccggagaaaaagaacgccaatcctttctcggtattgtcggcacactggacgaaaacgaaaaacgccagctgattcacgaagtgctctctccgctcggccataatctgatggtcacaccgaaggagattgacacctttattgatgatatggcgaacgtgcttgcaaacgggttaaacaccgcccttcatgaaaaagtgtcacaagataacaaaggttcttataatcattaaaatggttctacctcctctagcttgttcatagagtaattactagacaagcgctggagggattcaaatcatgagaaaaaaacgcagaaaccgtcaaattgtcgttgcagtaaacggtggaaatgcgctcaagggcatgtttttgtttatgacaagccttatcgttattttcgtattatcgggtgtgctcacatcgcttcgccctgaactgaggctttcttcggattctcttcacggaattgccggagaacttccgggtgacgcgtttgcacacctcctcggtatggaaaatcattatttcgcctcagagcttcctgaaaaagactcttttcagctgtcccggctttccttaaaactggcgacaagcattaatatggaagacccgcggagtttcttgggacgtgagctgccgggatttgcccaatacgatacggagatccttctggcggggcaggggactgattatacgaatatgcctgctgaatccccgccgccgtcaaaggtgatggaaaaagaaaaagaagtgaacctggcagaaatcgaaaacaaaacgaaaaaagaagaaacggcgccgccgaaacattcaacaggcagcaaaaaagtcgtttttatttaccacactcataataccgaatcctatcttcctctcttaaaaggggaaacaaatccggataacgcccgccattcgaaggccaatgtcacgcttgtcggagatatgttcggaaaagcgcttgaagcgcaaggtgtaggagcgaccgtagataaaaccgacattcaggcccgcctgaacaaagacggcttaaattatgcgcgaagctacgacgaatcaaggccggtcgtaaaaagcgcgctcgccaaaaataaaaacctgcaatataccatagacattcaccgggattcccgccgcaagaaaaatacgacagccgacatcaaaggaaaaagctatgccagggtcgccatcgtcgtcggcaaaaaaagcgctaattttgaagaaaactataaactcgcaagtgaacttcataagctgatggagaaaaaatacccaggcttaagcgtcggtgttttatcaaaaggctctccgggagataatggagtgtacaaccaggatttaaacgaccggtcgcttctgctggaattcgggggcgtggataacaatcttgaagaactgaggcgcgcatcagatgccgcggccgatgtattcagcgaactgtactgggatgcagacaaggtcagctcgcaatcaggagagaagaaaaaacaatagaaatcaggtgatgcaaatgatccgttttaccggcaaatgcctgctgatcgctattgtcatgtttgtcggcgttttgttcggcatgcagcaggcaaacagcggaatgcttgatatgaaaggatacaaagatccctccttaaaaggagcattcacgctcggcggcggagaaggacaggaaaaagaagcttccattttggggcaaaccgttacggcgaaagatctggaagaaaaacaaaaacagctggaacaggcggaaaccttcaacctgttttcaaaagcgggagaaaccctttcaaataccgtgacggactcggcacaggcgatgtatgagtgggtttcgaaactgaaccgttagcattgatgaagagaaaagcggatgattccttaaaggaagcttttctctttcttgttttaattgaatgtttacaatcctattgatataatctaagctagtgtattttgcgtttaatagtaggagtgatagattgtgacagataaagaaaagcgtttagagaggcagtcaagaatccggaatttctccatcatcgcccacatagaccacggcaaatcgaccttggcggatcggattttagaaaaaacatcggcgatcacccagcgggaaatgaaagaacaattgcttgattcaatggaccttgaacgcgaacggggaattaccatcaaattaaattccgttcagctgaaatacaaagcaaaagacggagaagaatatatattccatctcatcgacacgcccggacacgtcgactttacatatgaagtttcgcgaagcctggctgcctgtgaaggcgcgattctcgttgttgatgcggctcagggaatagaagcgcagacattggcgaacgtctatctggcgcttgataatgatcttgagattcttcctgtcattaataaaatcgatcttccgagcgcagagccagaacgtgtgcgtcaagaggttgaggacgttatcggccttgacgcttcagatgccgtcctcgcttcagcgaaagcgggcatcggcatcgaagacattttagaacagatcgtagaaaaagtgccggctcccgcgggagatccggaagctccgctgaaagcgctcatctttgactcgctttatgacgcgtaccgcggagtcgtcgcgtatatcagagtcgtagaaggaacggtcaaaccgggccagaaaattaaaatgatggcaaccggaaaagagtttgaagtcatcgaagtcggcgtcttcacgccgaaagcgcagccggctgacgaattgacagtcggtgacgtaggctatttgacagccgcaatcaaaaacgtcggcgacacccgtgtcggtgatacgatcacgagcgcggttaagcctgcggcagaagcgcttccgggctaccgcaaactcaatccgatggtatactgcggactttatccgattgacacagccaaatataatgatttgcgcgaagctctggaaaaacttgaattgaacgattcatctcttcaatacgaggcggagacgtcacaagccctcggcttcggtttccgctgcggctttttaggaatgcttcacatggaaatcattcaagagcggattgaacgggaatttaaaattgaccttattacgaccgcgccgagcgttatttatgacgtttatatgacggacggcgaaaagatcatcgtggataacccgtcaaacatgcctgacccgcagaaaatagagcgggtggaagaaccttatgtcaaagcgacgatgatggtaccgaacgattacgtcggagcggttatggagctttgtcaggggaaacggggcaactttatcgatatgcagtacttagacgccaaccgggtcagcattgtatatgagatgcctcttgcggaaatcgtatatgaattttttgatcagctgaaatccagcacgaaagggtacgcctctttcgattacgagctgatcggctacaaaccgtccaaactcgtcaaaatggacattatgctgaatgcagaaaaaattgatgcgctgtcgtttatcgtgcaccgcgattacgcatacgagcgcgggaaagtcatcgtcgaaaaattgaaagaattgatcccccgccagcaattcgaagtgcccgtgcaggcagcgatcggacagaaaatcgtggcccgctcaaccattaaggccatgcggaaaaacgtccttgcaaaatgttacggaggagacatctcgcggaaacggaagcttcttgaaaaacaaaaagaaggaaaacgccggatgaagcaggtcggctcggtagaagtgccgcaggaggcgtttatggccgttcttaaaatggatgacagcccgaaaaaataacggaagccgccgcagtcccgcgctgcggcttctttctgtaaagaagaaggtgtttcaaaatgaaatcagcttatattcatattccgttttgtgagcatatctgccactattgcgatttcaataaatattttattcagagccagcctgtcgatgagtacttaaactcactcgaaaaggaaatgataaatacaatagaacggacgggacgccctgatctccgcacgatttttatcgggggaggcacgccgacatcgctctcacccgcccagctggaaaaattgatggattccattcaccgcgtgctgaagccttctgacggactcatagaatttgccgcggaagcgaatccggatgatttgtccccggaaaaattaaaaatcatgaaaaatgccggtgtcaaccggctgagcttcggtgttcaaacctttgaagatgagcttttacaaaaaatcggcagagtgcataaacaaaaggacgtattcacttcctttgaacgtgcgagggctctcggctttgacaacatcagtctcgatttgatgttcggcctgccgggtcagacgctggccgatcttgacaattccgtcaaaacggctttgtctcttgatgcggagcactattccgtttactcgctgatcgtagagccgaaaacggtgttttataatttaatgcaaaaaggccgcctgcatctcccggcgcaagaacaagaggccgagatgtatgaaacggtcatgaggcagatgagtgaagcgggcatccgtcaatacgagatcagtaactttgcaaagccaggatacgagtcgcagcataatctgacgtattggagcaatgaagcgtatttcggttttggcgcaggcgctcacgggtatatcagcggcacgcgcaccgtcaacgccgggcctgtgaaacattacattcagctcatcgaagaaaaggggctgccttaccgtgacacgcacgaggtgacacgggaggagcagattgaagaagaaatgttcctcggtctcagaaaaatgtccggcgtacaaaagcaagcttttctcgataaattcggacgctcggtcgacgaactgtttcccgatgttctcaaagatttaaccgaaaaaggcctgatctgtgacacggaagaatcggttgcattaacgcatgagggcaaattattaggaaatgaggtttttggcgcttttttgggtgagttataattgacatttttcttttggtttgttacttttgatatagaattagcactcgctgaccttgagtgctaacaggggtgatgatgatgttaacaaatcgtcagctgttgatcctgcaagtgattattaatgattttatacaatcagcgcagcctgtaggatcaagaactctttcaaaaaaagacgagattacattcagctctgcaacgatcagaaacgagatggctgacttggaggaattgggctttattgaaaaaacccattcatcctcaggacggattccgtcggaaaaagggtacaggtattatgtcgatcatttgctgtcacccgtcaagctgacaaaaaccgatctggatttaattcactcgatatttaaagaaaaaatcttcgagctggaaaaaacagtccaaaaatcagcgcaaatcctgtccgacctgacaaactacacatcgattgtcctcgggccgacgctgagcgagaactatcttaaacagattcaaatcgttccgatccagccggataaggcggtcgccatcctcgtcacgaacacggggcatgtcgaaaaccgcaccatcaatttcccggctaaagtggatttggccgatattgaaaaactggtcaatatattaaacgatcgattagcgggcgtgccgatggacgaactgaatgagcgcattttcaaagaggttgtcacatatttaaggcagcatatcgccaactatgacagcatacttgaatcgctccgctccacattccatccggcggcccacgttgagaaattgtttttcggcggaaagatcaacatgctgaatcagccggagtttcacgatattgaaagggtccgctcgctcttatctttaattgaaaaagagcaggatgttctgaagctgtttcagtcatcaaaagccgggatttcaatcaaaatcgggaaagaaaacgactacgaagaaatggaaaactgcagcttaatcacggccacctatacagttgatacgaagcagatcggatcaatcgcgattatcgggccgacgcgcatgaattattcaagagtcgtcagcctgctgcagcacgtgacttcggacttgtcaaaagcattcacaagtttgtatgatgaataagggaattttggcaatcattttcagtcatctttttacagcatttgagggaggtgaacacaatgtcagaagaaaaacaaaccgcagaacaggtcgaagcagcagaacaagaagaagtgacagaacaggcagaacaagcggcttcacaagagcagcatgaagaaacggcaggtcaggaagaagcccttcagcaccaaattgatgaattgcagggtttgcttgatgaaaaagaaaacaagcttttgcgtgttcaagcagactttgaaaactataaacgacgcagccgccttgaaatggaagctgctcagaaataccgttctcaaaacgtcgtaacggaaatccttccggctctcgacaactttgaacgggcgttacaggtagaagctgaaagcgagcagacaaaaagcttgctgcaaggtatggaaatggtccgccgccagctgatggacgcacttgaaaaagaaggtgttgaagccatcgaagctgtcggtcaggaatttgatccgaaccttcaccaagccgtcatgcaggtggaggatgaaaacttcggcagcaatattgttatcgaagaactgcaaaaaggctacaaactgaaggatcgcgtcatccgtccttcaatggtaaaagtgaatcaataactacatagcaggaggtaattcaaagtgagtaaagtaatcggaattgacttgggtacgacaaactcatgtgtggcagtgcttgaaggcggagagcctacagttatcgccaacgctgaaggaaaccgtacgactccgtcagtcgttgcatttaaaaacggcgagcgccaagtaggggaagtggcgaaacgccaatcaatcacaaatcctaacacaatcatgtctgtcaaacgccatatgggtactgactataaagtggaaatcgaaggaaaagactacacgcctcaagaagtgtcagctattatccttcagcatctgaaagcatacgctgaaagctacctcggcgaaacagtttcaaaagccgttatcacggttcctgcatacttcaacgatgcagagcgccaagcgacaaaagatgccggtaaaatcgccggtcttgaagtagagcgtattatcaacgaaccgactgcagcagcgcttgcatacggacttgataaaacagacgaagaccaaacgattcttgtttacgaccttggcggcggtacgtttgacgtatctgttcttgaacttggcgacggcgtgtttgaagtccgttcaactgccggtgacaaccgtcttggcggggacgactttgaccaagtcatcatcgatcatctcgtagcagaattcaaaaaagaaaacggcattgatctttcaaaagacaaaatggcgcttcagcgtttgaaagatgcggctgagaaagcgaaaaaagatctttccggcgtatcatctacacaaatttctttaccgtttatcacagcgggagaagcaggtcctcttcaccttgagctgacactgacccgcgctaaattcgaagagctttccgctcaccttgttgagcgcacaatggctcctgtccgtcaggctcttcaagatgcggatctttctgcgagcgaaatcgacaaagttatccttgtcggcggatcaacacgtatacctgccgtacaggaagcaatcaaaaaagaaacgggtaaagaagcgcataaaggcgtaaaccctgatgaagttgtagcgctgggtgcagcgattcaaggcggcgtcatcacgggagacgtaaaagacgttgttcttcttgacgttacaccgctttctctcggtattgaaacaatgggcggcgtgttcacgaaactgatcgaccgcaacacgacaattccgacgagcaagtctcaagtattctcaactgcagctgacaaccaaacggctgttgacattcacgtgcttcaaggtgagcgcccgatgtctgcggacaacaaaacgctcggccgcttccagcttactgatatcccgcctgcaccgcgcggcgtaccgcaaatcgaagtttctttcgatattgacaaaaacggtatcgtaaacgtaagagcgaaagacttaggcacaggaaaagaacaaaacattacaatcaaatcttcttcaggtctttctgatgatgagatcgaacgcatggtaaaagaagcggaagaaaacgctgacgctgatgcgaagagaaaagaagaaatcgaagtccgcaacgaagctgaccagcttgtgttccaaacggaaaaaacattaaaagatctggaaggcaaagtggacgaagagcaagtgaaaaaagcaaacgacgcgaaagacgcgctgaaagccgctatcgagaaaaacgaaattgaagacatcaaagcgaaaaaagatgagcttcaaacaatcgttcaagagctttctatgaagctttatgaagaagcggcaaaagcgcagcaggctgaaggcgcagcaaacgctgaaggcaaaaaagcggacgacaacgttgtcgatgcggaatacgaagaagtaaaagacgacgaaacgaaaaaataagttctttcccgcatggctataggcggaagaacacacagcatattctgattcaacagacagaaagtcaaagtcaggcatctcttggctttgactttttttcttgcccgggataaaaggaattgaaaaaacataattcaaaatgatacaatctaatttatgtgagaaattcgggagagtgaagcgagatgagtaagcgtgattactatgaagtgcttggggtaagtaagagcgcttcaaaggatgaaatcaaaaaagcctatcggaagctttcaaaaaaatatcatcctgatatcaataaagaatccggagcagatgaaaaattcaaagaggtaaaagaagcgtacgaagcgctctcagacgaccaaaaacgcgctcaatatgaccaattcggccatacagaccctaaccagggattcggcggcggtttcggaggcggcggagacttcggcggcttcggtttcgatgacatattctcaagcatcttcggaggcggcacgagacgccgtgacccgaatgcgccgcggcaaggcgcggatctgcagtatacaatgaccctgtcatttgaagacgcggctttcggaaaagaaacgatcattgaaattccgcgcgaagagaattgcgaaacatgtaaaggatcgggcgcaaagccgggaacaaagccggatacgtgctcgcactgcggaggttcaggccagctgaacgtcgaacagaacacgccgtttggcaaagtggttaaccgaagagtctgccaccactgtgaaggaacaggaaaaatcatcaaaaacaagtgttctgactgcggcggcacgggcaaagtgaaaaaacggaaaaaaatcaatgtcacgattcctgccggtgtggatgacggacagcagctgcgcgttccgggtcaaggtgaacctggcgtaaacggagggcctgcgggagatctgtttgtcgtattccatgtgcgcgcccacgagttctttgaacgcgacggagacgatatttattgcgaaatgccgttaacgtttgcccaagcggcactcggagacgaagtggaagtgccgacgcttcacggaaaagtgaaattgaaaatacctgccggcacacaaaccggcacgaaattcagattaagaggcaaaggcgttcagaacgtccggggctacggacaaggcgaccagcacattgtcgtccgcgtcgtcacaccgacgaatctgacagacaaacaaaaagacatcatccgcgagttcgctgaagtcagcggaaacctgccggatgaacaagaaatgagtttctttgacaaagtaaaacgcgcatttaaaggcgagtaatgattggataggagttggtagttttgaaatggtccgaaatcagcattcacacaacacatgaagcggtcgaacccatctcaaatattttgcatgaagctggtgcgagcggggttgtcatcgaagatccgcttgatttaatgaaagagcgtgagaatgtttacggggaaatctaccagctcgaccccaatgattaccccgatgagggtgtcattgtcaaagcgtatctgccgattaacagtttcctcggcgaaacggtggacggcattaaagagacgattaataatctgcttttgtacgacattgatttaggcagaaacacaatcaccatttctgaagttaatgaagaagaatgggcgacagcttggaaaaagtattatcatccggtgaaaatttctgaaaaattcacgatcgtacccacatgggaaacgtacacacccgtgaataccgatgaactgattatcgaaatggatccgggcatggcattcggtacgggaacgcatccgacaaccgttctgtgcattcaggcgcttgagcgtatcgttcaaaaaggcgatcgtgtcattgatgtcggcaccggttcaggaattttaagcatcgcggccgccatgcttgaggccgaatcggttcatgcgtatgaccttgatccggtcgctgttgaaagcgcgcgtctgaatctaaaattgaacaaagtgagtgatacggccgaagtgaagcagaacaatttgttagacggcatcacgggcgaacatgatgtcattgtcgcaaatattctggcggaagtgattctccgctttacatcacaggcgtacgacctgctcaaagacggaggccattttattacttcaggcattatcggccagaaaaaacaggaagtaaaagaagcgttggaaaaagccggctttaccatcacagaaattctgtctatggaagattgggtcagcatcatcgcgaaaaaataacagttagtaggtgtcacagcgtatgcaacgatattttatcgagctcacgaagcaggagatggacgaaactcccgattttcaaattacgggggaagacgtccaccatatagcgaacgtcatgagaatgagtgcgggagaccggataatctgctgttcgaaagacggccatgaagcgttatgcctgctcaaagcggtttctaaagatcatatatcatgcagcattgctgaatggacgggtgaaaaccgtgaactgccgttaaaaatcaggattgccagcggccttccgaaaggcgataagcttgaatggattatccaaaaagggaccgagctgggggctagtatgttcatcccctttcagggcgccagatccgtcgttaagctagacgacaaaaaggcaaagaaaaagcgggagagatgggcgaaaatcgcgaaggaagcggcggagcaatcgtaccgcaatgaaattcccgaagtgaaaaccgttcatacgttccggcagctgcttgaaatggcggagaatgtcgataaatgtgtcgttgcatacgaggagtcatcaaagcagggagaaacgggcgctttcgccgcggagcttaaaagccttccgcaaggttcgtctcttttaatcgtattcggccctgaaggcggtctgactgagtctgaagttcatcagctttcagaaaaaggcgccgtcttatgcggcctcggaccgagaattttacggactgaaactgcgcctctttacgcgttaagcgcagtttcctatcatacagagttattaagaggtgatcagtaatggcaactgttgcttttcatacccttggctgcaaggtcaatcattatgaaacagaagcaatctggcagctgtttaaagatgcgggttatgaacgaaaagaattcgaacagacagcagatgtatatgtcattaatacatgtacggtaacaaacacgggagataaaaaaagccgtcaagtcatcagacgggcgatccgccaaaatcctgacggcgtcatctgcgtaacagggtgctatgcgcaaacctctccggcagaaattatggccatcccgggtgttgacatcgtcgtcggcacgcaggatcgtgaaaaaatgctcggttacattgagcagtacagggaagagcgtcagccgatcaacggcgtcggcaatattatgaaagcacgcgtgtttgaagagctggatgttcccgcttttactgaccgcacaagagcgtcgttaaaaatccaagagggctgcaacaacttctgtacgttctgcattatcccttgggcgcgcggcctgcttcgttcccgcgatccggaagaagtcattaaacaggcgcagcagctggtggatgccggctataaagaaatcgtcctgacggggattcatacgggcggctacggcgaagatatgaaagattataatttcgccaagcttctccgcgagcttgatacacgtgtagaaggactgaagcggatcagaatttcatctattgaagcaagccaaatcactgatgaagtgattgaagtgctggatgcgtctgataaaatcgtccgccaccttcatatcccgattcagtcaggatcaaacaccgttctgaaacggatgagacgcaaatatacgatggaatttttcgcggaccgtttaaataagctgaaagaagcgctgccgggtcttgccgtcacatctgatgtcatcgtcggtttcccgggtgaaacggaagaagaatttatggaaacataccggttcattaaagaacataagttttcagagcttcacgtattcccttacagcaaacgcaccggaacacctgcggccagaatggaagaccaggttgacgagaacgtgaaaaacgaacgggtgcataagctgattgcgctgtctgaccagcttgccaaagaatacgcctccgattatgaaggagaggttctggaaatcattccggaagaggcgtttaaagagtctgatgaggccggcatgttcgtcggctatacggacaattacatgaaagtcgtcttcaaaggcacggaagatgtaatcggcaaacttgtcaaagtcaaaattcaaaaagcgggctatccgtataacgaaggacaattcgtccgcgtcgttgaggatgaaatgacccggaacatgcgcatgtcttcataacagataaaaaaaccggtgccttcccgcatcggtttttttacggtttcggaggaatcagcctgtcaatcagccggtaaaacaaatgtgtgaacggcagaaacaataaggcggtgactacgttaaataacaggctgaaatgcgcaatcatctgcgcgggatcatcagacaggcgctccgtaatacctgctgatgcggacaggaagggaaagacgagcagcacaccgagaatattaaacactacgtgagcaccggcggtctgtctggcggcataaccgcctgaaacagcagccatgacggccgtgacgcatgtcccgatattagatcccagaacgacgctgaccgcttgttcaatgccgatcaccccttcgttcataaaactcatcaaaatgccgatgcagacggagcttgaatgaatgattgccgtcaatatcatgccgataaaaagagcggaccagctcgaatcattcacatggcgcaaaacctccgcccccgccttcatttctgtcagcggaacggcaagccggctgaagcatgtgatgcaaaaaaagatgatgccgagaccgaggaagcttataccgatctgcctgaacggatatttacggatgagggtaaacacaaggcctccgataaaaagcacccaaatgagcacatccatctttatggctaaaaactccgtcgtaaacgtggagccgacattcgtgccgagaatcatcggaatggtccgtttaaaagataaagcgcctgcgctgacaaagccgatgacaatgaccatgaaggctgagctgctctgaagaaaaccggtgaatacgatgcttatgagaaaagctttcaaagggtggtcggtaaataagagcaggcttttctcaatttttgaatacgttaatgcgatcaggccctgcctgagcaggctcattccgagtaaaaaaaccaggataagtgcggtaaagagaatcagtattatcaaacgaaacacccctttccatcattatatagacaagcagccttattcatgacggaaaagtgagctcgcttagttgacctgactgatggcttatattataatgtcaaagtacatgtttatatatgtatctttttaaaggtagtcgattggtgtattcggagggagggaaagagaatgtcaaaaacggtcgttagaaaaaacgaatcgcttgaagatgctcttcgtcgcttcaaacgcagtgtatcaaagacaggtactttgcaagaagcaagaaagcgcgaattttatgaaaaacctagcgtaaagcgcaagaaaaagtcagaagctgctagaaaacgcaaattctaaaagagggtggatttatgagtcttcttgagcgacttaaccaagatatgaagctgtatatgaaaagccgtgagaaagacaaactgactgtcgttcgaatggtgaaagcttcacttcaaaacgaagcaattaagcttaagaaagacagtttgaccgaggatgaggaacttactgtcctatctcgtgaacttaagcaacgtaaagactccctccatgaattttcaaacgctgatcgtttagatttagtagataaagttcaaaaagagctggacattttagaaatttatttaccgaagcagctttctgaagaagagctgcagacaattgtaaatgaaaccatcgctgaagtcggtgcgagctccaaagcggacatgggcaaagtgatgagtgctattatgcctaaagtaaaaggtaaagctgacggcagtgtaattaacagacttgtcagcagtcaattatcttaattgacaagaaaaaagacatctttcttagagagatgtctttttttatacataaaaaaatgaaactaaagtacatttgttacgtatataaagaagaacgaaacgggaaggagggtatatttgccttgttccgaaaaaaaaacggaattgctgttgctctattgggcttatttgtattatctttattaggggttcaattgaacgcgaaagctgatcacccatcggtttatgtcatcccggttgagaaaaatgtcgaacaggggctcgcctcgtttttatcgcgttctttcaaagaagcgaaggagtccggcgcgtcacacattattcttgacatcaatacaccgggaggcgccgttcaatcagccttggatattgcggatatcatcggccgcgcggatgtgcctgttaccgcttacgttaataaacgggcgctttctgccggagcgtatatagcgcttcaggcagatgaaatctatatggcgccgggaggaaaaatgggtgccgcagccatcatcgacggaaaaggaaacgcggcggacaaaaaggctcaatcactgtggcatgcagaaatggaggacgcagcggttaaaaacaaccgaaatccgaaatacgcccttgccatggcagatcccgccatcaatgcaaaggaagcgggcgccccaaagggaaaactgctgacactgacagctgaaaaagccaaggaagtcggatattcggagggcacggtttcaaaccttgatgctttatatacaaagctcggttttgacaaagcggatgttcaccatgcaaaagaaggttttgtcggcaaattgggcagatggctgacaaatccgtttgttgtccccgtcttattaacgcttgctttgcttggtttgaccattgaattgttctcgccgggcctcggaataccgggtgccgtcggactgacggccatgctgctgtttttcaccgggcatatcgctgccggattcgccggctatgacagcgtattcttattttgcgcgggcttggtttttatccttttagagatatttctgcccggaggcataatcggtcttatcggtattgcaggcgtcatcgcgagcctctttctcgctgcgggcagctttaccgtaatggcggtttctctcttgatcgccattgctgtgtctattacagcctttatcatattaacaagggtgttggggaaacgaatgaaattctttaaaaaattaatattaactgattcaacaaacacggagagcggttatgtttcaaatcagaaccggacggagctgttggggaaagtcggcattaccgctacagccctcagaccgtcaggcaccgtcattattgatgatgaacgtctggatgtcgtctcggaaggatcattcactgaaaaagacagacaggtgaaagtagtgaaagcggaaggctcacgcattgtcgtgagagaaatatagatgataaccttgaggaggaattagatggaactgtcaagtttggcgattttagcaatagttgcagctgccataatcgtgttagccatattcttcacctttgtaccggtgatgctatggatttcggcgcttgcggcaggagtcagaatcagcattttcactttggtcggaatgaggctgcggcgcgtcataccaagccgcgttgtcaatccgttaattaaagcgcacaaagccggcctatccgcaacaacaaatcagctcgaaagccattatctggccggtggtaatgttgacagggtggtcaatgccctgattgcggcacagcgcgccaatattgagctgacatttgaacgctgcgcagccattgacctggccgggcgtgacgtattggaagccgtgcagatgagcgtcaatccgaaggtcattgaaacaccgtttatcgcgggtgtcgccatggacggaattgaagtaaaagcaaaagccagaatcaccgtaagagccaatatcgagcgccttgtcggaggagcgggagaagagacggttgtcgcccgtgtcggagaagggattgtctcgacaatcggttcctcgggtaatcataaaaaagtgcttgaaaaccctgatatgatttcgcagaccgtacttggcaaagggctggattcaggcaccgcctttgaaattctttcgattgacatcgccgacgttgatatcggcaaaaacatcggagcgattcttcaaacggatcaagcagaagcagacaaaaacattgcgcaggccaaagccgaagagcgccgcgccatggcggtcgcccaagagcaggaaatgcgcgctcgcgtagaagaaatgcgtgcaaaagtcgtggaagcagaagccgaagtgccgcttgcgatggcagaagcgctgcgtgaaggaaacatcggcgtcatggactatatgaacataaaaaatatcgacgcggatacggacatgagggattctatcggcaagctgacgaatgaccagcaagatgaagaccaacaataacctctctattaaggagggagccgctatatgcacgagattctgacaaatccgctcgtcattgccgccgtcatcggcattatatcggcaatattcggcaagaaaaacaaagatgaaaaacggccgccgggtacacgccccgaaaatcaggcaaaaaagcaggatcaaaaacagccgcagaaagagcataagccggaagcggaagaattgcctgccgtttcagaagagaacccttttgagcaaaaaagaagggaagctgaaaagcgcctagcggagacggagcagatgtttaacgggcttgaacataagctgacatctcaacgcgcacgaaacgcgtctctgaagaaatcagccctcaaaataaataaagaaactgcggttcaaggcattatattcagtgaggttttgggtccgccccgtgcaaaaaaaccgcaccggaccatgcggagcatcggtaaaaaataaagtgttagaaccccttttcaaatcatacatatgagatgaaagggggttctttttttatggggcaaagaaagaatcgtgtaaaggcatggctgacaagagcattggaaattcccccggacgttatgatggatctgcctcggattacgatggtcggcagacttcatatctacatagagaatcacagaggcctcctgctgttcagcgaagaagaagtcaggctgatgctcaagcaggggcaatgtatcatatcaggaaaaaacttggtcattaaggcaatccttcctgaagaaattcttttggaaggcacgatagatcacgtacgatatgtcgattcataaagccggggggaaataatgtgaaaaacaaatggctgtcatttttttcgggtaaagtccaaatggaagtcaaaggaaaagggattgaacggctgctgaatgaatgcacgagaaacggaatcgccatctttgcggtgaaaaaaaagcaagactgtgttctgctgatgattcagcttcaagatgtacatgctttcagaagagtcatcagaaaacatgaatgcaaagcaagctttacaaaaagaaagggtcttccctttctgcttctcaaatcaaaattaaacctgggcttcactgcgggatttgtgatgtttttcgttatattgtttcttttgtccaacatgatttgggacattgatattaaaggggccaagcccgaaaccgagcatcagatggtaaagcaccttgaagaaatcggtgtgaaaaaaggacgtttgcaatttttaatgatgacgccggagaaaattcaaaaatcattaacaaacggcattgataatattacgtgggtcggtgtggaattgaacgggacagcccttcatatgaaagtggtcgaaaaaaacgaaccgacaaaagaaaagtacgtgagcccccgccatatcgttgccaaaaagaaggcggtcatcaaaaggatgttcgtgcaaaaggggcagccgatggcttttgtgaacgatcatgttgacaaaggacagcttctcgtctcaggactgatcggaaatgaagatcggaaagtcgcctcaaaagcggaaatttacggggaaacatggtacaagtcagaagtaaccgtgcctcttgaaacatcatttacgctatatacgggtaaagtaaggacgaagcacaagctgtctttcggatcatggggcgtgcctttttggggctttgaatttaatgaggagccgctgaaacatccgaaaacagaggaagaaaagcacccgtttcaatttctggggatgaagcttccgatttcttacgttcaagaacagacaagagaaagtgaaacaaccgtgcggacttatacgaaaggcgaagcggttcaggccggtatcaaaatgggaagacaagatgtagaaaagcgattaaacggcagcggagaggtggaaagtgaaaaagttttgcaccaatccgttgagaatggtaaagtaaagttgattattctctaccaagttatagaagatatcgttcaaaccacacctattgttcagggagactaaagaatggcagaacatttacttgcgattaatcacaaactgaaaagcccggacgaagcactttctttgttcggcagccaagatgcctttttacatttaatggagaaggatctgggcattagcctcatcacgcgcggtgaaaccatttacgtttccgggaatgatgaaacatttgagatcgctgacagattattgggctcgctccttactttaattcgcaaggggatcgagatttcggaacgtgatgtgctgtatgccgtgaaaatggcaaaaaaagatgaactggactattttgaaagcatgtatgaagaggaaataacgaaaacggcaaaaggcaaaccgatccgtgtcaaaaccctcggccaaagagaatatgtggcggcgatgaagaaaaacgacatggtgttcggcatcgggccggcgggaaccggcaaaacttatttggcggtcgtaaaagcggtgcatgctttaaaaaacggccacattaaaaaaatcattttaacaagacccgctgtggaagccggcgagagcctcggctttctgcccggagatttaaaggaaaaagtagatccttatctgcgcccgctgtatgacgcgctccatgatgtgctcggaagcgaccatacggagcgtcttatggaaagaggggttattgaaatcgccccgcttgcctatatgagagggcggacgcttgacgacgcgtatgtgattcttgatgaagcccagaataccactcccgctcaaatgaaaatgtttttgacgagattgggttttggctctaaaatgatcattacgggcgacgtaagccaaattgacctgccgaaaggcgtcacatcgggacttgcagtagcgaaggatatgctgaaggacataaacggcatctccgtgattgaacttgaccagacagatgtggtcaggcatccgcttgttgcaaaaattattgaagcttatgataagcaaaagtaatgcaaaaatgacccgatctcccgttatcgggtcatttttatatgatgtgttcctgatgtttcagggaggaggttcttgttttgaaaaagaaggaaaagggcaaaagcgcccgggaacggttccgcagtttcagacatgcccgctcagcccatgtgctgctgtacctgctgctttcagcgatcatgtttggtttgctctttattcatgtaaaacctgaatcacttaatttggatttgttttcagtcagtgataagacgatttacgcgcccgccacagtggaagatcagcaggcgacggaatcgaaaaaacaggcggccgaagatgcggtggaagatcaatacaccctgaaaaaaggctataccgacaaccggcttgacctgatcacttccatttttgacagcatcggcgaagtgaaaaaagatgcggaaaaagacaaaaagtcaccttcggaaaaatcattggtcaaatcggtgaaaaacaagctgacacaggatgtcaatgaatccgtctcggaagatgccattaaatcgcttctccatgcaaacaatgaagatttctcatttgtgagggattccgtcattaccgcggtgaatacggtgatgagcagtgaaattccttctgaaaagcttgccgaagcgaaggataaggtcgcaaaagagctgaaaagcgcttctgtgccgtcaaaatatttagcggctgcgactgaaatcggaaaatacgcggtcattccgaattacgtatttgatccgaaagcgacggatgaaaaacgccaggaagcgtcagacagcgtccagccggtacagatcaaacagggacaggttctcgtggaagagaatgacctgatcgaccgggaagtatacaggaagcttgaactgacggggcttttgaataattccaacctgttaaagccgatcagcggtctgcttctgatgatcgggctgtttatcgccacgcttgtctactattttgagaaacagcagcaggagcttaagctgaaaaataaatctcttttgctgttttctatcattacaacgcttattctcgtcattatggaagtcgtcagtctctttcagaagattgaatacaccaatatcggctatcttgtgccgatcgccgccggcgcgattttaatcaggctgctgctcaatgaaaggctcgccattttaggaagcatcattctggcgatctgcggcagtatgatgtttaatcagggtgtgacgggaacatttaattacgtcatcggcatttactatttaatcagcagcatttcaggcattctgtttttggggaaacacaatgcgagatcaaaaatattgcaggcgggactgttcgtctcatttattaatatgattatcgtgctgtcgcttttattaatacaaaatacggcgctgtcacctgttgaaatcggaacgctgatgctgatgggggtcgtctcgggacttgcttcatccgttttgattatcggtctgatgccgttttttgagacgggattcggcattctttcaacgatgaggctgattgaactgtctaatccgaatcatcccctgcttcgaaagattttaacggaaacacccggtacatatcatcacagcgtcatggtggcaaatctgtcggaagcggcttgtgaagccgtaggggcaaacggtcttttagcacgggtcggagcgtattatcacgatctcggcaaaacgaaacgtccgcaatattttattgaaaatcagatgaatatggataatccgcatgacaagctgtctcctcagctcagcaaaaatatcattatcgcacatacgacagacggtgcgaatatgctcagaagctataagtttccgaaagagcttgtggatatcgcggagcagcatcacggaacgtcccttttaaaattcttttattataaagcgaaagaaaagggcgaccagattacagagaaagagttccgctacccggggccgaagccgcaatcgaaagaagcggctattatctcagtggccgacagcgttgaagccgccgtccgttccatgcataatcccaatcccgagcggatcgaaaaactggtgcggggaattatatccgataagcttcaggacggacaattctcagaatgtgatctcacgttccgagaactggatacgatcgccaaaacgctatgtgcgactttaaaaggaattttccactcccggattgaatatccggaggctacgaagaaggtgaaataaatgggtttactcatagatattgttgatgaaacgaacagcgtctcagctgatgcgctccaagaagtggagaagctgctccaattcgcggcggaaaaagaaggcgttcaggatcaggctgaagtatcggtcacgattgtgacaaatgaagaaatcagagaaatcaacagagactaccggggaaaagacactccgactgacgtcatttcgtttgcgcttgaagaagaaggcgaagacgaggtggaaatcgtaggcgccgacatgccgcctgttttaggagatattatcatcagcgcagacagaacgaaagagcaggcggaagagtacggccattcgtttatgagagagctcggttttctggccgtgcacggctttttgcatttgcttggctatgatcacatgacaaaagaagaagaggaagaaatgttttcaaagcaaaaggatttgctggatgagtatggactcacgagatcataaaaacgagtggagcaggttcctgaagagctttgtccatgcatggaggggaatctggaaaacggcgcggtcagagcggaattttcaatttcatattaccgcggcctgcgccgttatcgtttgcggttttctcaccgggctgagcacagccgaatgggccgttgttttggtgctgatcggagggatgcttgctttggagcttttaaatacggcgatagagcatgttgtggatttagttactgatcagtatcacccgctcgcaaaagcggcaaaggacgcggccgccggagccgtttgcgtctttgccgtgatatcgtgtatcattggtttactcatcttcctgccgaagatatgttagcagaagattcttacaattattttacattgccaaaaatgggcgtgaaaaaccgatcataattatgtaaaataaaagtgacagcggtatcatacaggataaaggtaagagaggaattaagtacacatgaacagacaagaattgattgcagaagcattaaaagcacgggacacagcgtatgtgccgtattcaaatttcagagtgggagccgctcttcttaccaaagacggaaaagtgtacagaggctgcaatattgaaaatgcggcatacagcatgtgcaactgtgctgaacgcacggcgatattcaaagctgtttccgagggggatacggaatttgcgatgctcgccgtggctgcggatactccgggaccggtttcgccgtgcggagcctgcagacaagtaatttccgagctgtgctcaaaggatatgcttgttattctgaccaacttacaaggacaaataaaagaaatgactgcggaagaattattgccgggcgcattttcatcggaggatttacatgacgaacgaaagctttaaatcaggatttgtatctatcatcggaagaccgaacgtaggaaagtctacctttttaaacagggtcatcggtcaaaagatcgccatcatgagcgacaaaccccagacgacaagaaataaagtccaaggggtgctgacaaccggcacgtcgcagactatttttattgatacaccgggcattcacaaaccgaagcacaagcttggcgactttatgatgaaagtggcgcagaatacgctgaaagaagttgacttggtgttatttatgatcaacgccgaagaagggtacggaaagggcgacgagtttatcattgaaaagctcggacagacgtccacgccggtctttctgatcgtaaacaaaattgataagatccaccctgaccagctgcttcttttaattgatgagtaccgtgcgcgctatccgtttaaagaaattgtgccgatctcagctttggaagggaacaacgtcgaaacccttctcgcgcaggttgaagcgtatttaccggaagggcctcagttctatccgagcgatcaggtgactgaccatcccgagcggttcattatttctgaactgatcagggaaaaggtgctccatctgacaagggaagaagtgccgcacagcatcgctgtcgctatcgagtccattaaagggcaagaaaacggctccgtccatgtcgccgccaccattgtggtcgagcgggattctcaaaaaggcatcgtcatcgggaaaaaaggagcgcttctgaaagaagtcggcaaaagagcgcgggctgatattgaagcgctgctgggttcacgcgtttacctcgaattatgggtgaaagtgcagaaggactggcggaataaaatgtctcagctgcgtgatttcggcttcaaagaggatgaatattaattcatctgaagcgcatgcctgatgtgtgggattacctcacagaaacagggtttcgttagcaaaatttgtttaacatgaaaaggaggacatcaggtcaagataagggtaagaatttggattggcaagctagtttaatgatgaaaggtgggttttttgtgttgaattttacctggaacgtattttctcaaacaggaagtgttgatacgtaccttctttttaaagaactggaaaaagagaacctggaaagacccgaagaaccggaagatgagctagcccgaattgattttccaattttgtaaacctcttggcccctcccgttgttggaaggtgcggaaatgctgactaaatgtgaaggaatcgtgctccgtacgaatgactacggggagacgaataaaatcgtgacattgctgacgagggaacacggcaaaatcggcgtcatggcaaggggcgccaggaagtcagccagccggctgtcagcagtcagccagccgtttttgtacgggtcatttttaatgcaaagaacatccggactcggcacgctccagcagggtgaaatgattctcagcatgagaacgatcagagaagatttatttttgacggcgtatgccgcttttatcgctgaactcactgacaaaggaacggaagagaagaaaccgaacccctatttattcgaattgattctcgaatcctttaagaggctgaatgacgggactgacccggacgtgatcaccttcatcgtgcagatgaaaatgctcggcgtcatggggctgtatccggagctgaatcattgtgtccactgcaaaagcggggaagggacgtttcatttttcgataagagataacggttttatctgccaccgctgctttgaaaaggatccgtacagagttccgatttcgccgcaaacggcaaggctgctaaggcttttttattactttgatatcggaaggctcggcagcgtctcgttaaaacaggaaaccaaaaacgaaattaaacaggtcattgatctgtattacgaggaatattcaggactttatttaaagtcaaaacggtttttagaccagatggaaagcatgaagaaccttttggacgaaaacaaaagttgacattctgcccatctttttatatgatcatttattataaaatatgttgcagtgacagaaagaagtacttgcgtccaactcatacaagcgaccttaggacagtgtaagctaaggatgagcgcgcaacgaaaggcattctcgagcaaccctttaaaaagaggctgagtgattcacatcctcagcaactagggtggaaccgcgggagaactctcgtccctatgtttgcggccggcaagcatagagacgggagttttttggttgccgccgcacttgtaaaagaatggagaaagtggaggtgcttgaaatgaacattcaagatatgattttaaccttgcagaagcactggtcgaatgaaggctgtgtgctcatgcagtcgtatgatgtggagaaaggcgcaggcacaatgagcccgtatacatttttacgaagcatcgggccggagccgtggagagtggcttacgttgagccgtccagacggcctgcggacggacggtacggtgaaaacccgaacaggctctatcagcatcaccaattccaagtcattattaagccgtcgcctgataacattcaagagctttaccttgattcattgcgtgcgctcggcattgacccgcttgaacatgatattcgtttcgtagaagacaactgggaaaacccgtctttaggctgtgcaggtctcggctgggaagtatggcttgacgggatggaaattactcagtttacatatttccagcaggtgggcggaattgaatgtaagccggtgtccgttgagatcacatatggtattgaacgtctcgcgtcatatattcaggataaagaaaacgtctttgatcttgaatggacgtcaggatttactgtgaaagatttatttatgatggctgaatatgagcattccgtttatacttttgaaacatctgacgtggatatgcttttccatttgttcagcacctatgaaaaagaagcgatcagacaaatggataacgggcttgtgcatccggcctatgattatgtgctgaaatgctctcacacatttaatctgcttgatgcaaaaggcgcgatctctgtgacagagcggacgggttatatcggccgtgtccgcaacttagcgagaaaagtggcaaaaacgtattatgaagaacgggaaaaattagggttcccaatgcttaaagaggagggctcttcccatgagtaaacaagacttgcttttagagatcggactcgaggaaatgccggcgcggtttttacatgacagcatggtgcagctcggtgaaaagctgaccggctggcttgctgaaaaaaatatcgcccacggcgaagtgaaactttttaatacgccgagacgtctggcagtatatataaaagacgtagcagaaaaacaggctgatattcaggaagaagcaaaaggccctgcgaaaaaaatcgctctggatgctgacggaaactggacaaaagccgctatcggattttcaaaaggccaaggcgccggagtggatgacctgtatataaaagatgtaaacggcacggaatatgtcttcgttcaaaaattccaggcgggacaagagacgaagacacttttaccgcagctggaaaatttgattgccggaatgcattttccgaaaaacatgcgctggggcacgcaggatctgcgctatatccgtccgatcaaatggattgccgccctctttggaaaagacgtcattccgtttgaaatcacaaatgtcaagacgggccggaacacgcagggacaccgctttctcggccaagaagtatctgttgatgcgccgtcatcatacgaaaagctgctgaaagaacaaagcgtcattgctgacccgaaagaacgcaaacaaatgatccaaagccagctggatgcgcttgcggccaagaagaaatggaacattccggtcgatgaggatctgctgaacgaagtcaaccatctggtggaatatccgacggcgctttacggatcttttgaatccgagtttctttctatccctgaagaagtgcttgtgacaacaatgaaagagcatcagcgctacttcccggtaaaagatgaaaacgggaatctgcttcctcattttattacggtgcgaaacgggaacagccatgcaattgaaaatgttgcccgcggaaacgagaaagtgctgagagcaaggctttcagatgctgcgttcttctacaaagaagaccaaaagctgaacattgatgaaaacgtgaagaaattggaaaatatcgttttccatgaagagctcggctcccttggagataaagtaagaagagcggtcaccattgcgggcaaacttgccgtccgcctgaaagcggatgaacagacgcaaaaacttgtgaagcgcgccgcagagatttctaaatttgacctggttacacatatgatctatgagttcccagagcttcaaggcgtgatgggagaaaaatatgcgcgcatgctcggtgaagatgatgccgtcgctgccgctgtcaatgagcactatatgccgagagcggccgggggagaagtgccttcaacctttatcggcgcggtcgtggcgttagctgataaactggacacgattgcttccttcttcagcattgacgtaattccgacaggttctcaggatccgtacggattgcgccgtcaggcaagcggcattgtttccattctaatcgaccgcaactggggcatttcttttaaagaactgctgtcgttgacagaaacgaaaaaagagaacgagctccttgatttctttacacagcgtctgaaatacgtcttaaacgctgaagacatccgtcatgacgttattgatgccgttctggacagcacagagcttgagccgtatgcagccgttcataaggcaagagtgcttgagaagcacctcggcacacccggctttaaagaaacggctgaatcactcggccgggttatctccatcagtaaaaaaggcgagagccgcgatatcaagccggatctgtttgaaaatgaacaggagaaaaagctgtttgacgcttatgaaaaaacaaaagacagtgtcgcggaaagctttgcctccaaaaactatgaacaggcgcttgccgtgctcagcggattaaaagagccgatcgaagattactttaatcacacgatggtaaatgcggacgatgaagcattaaaaaccaaccgtttagcgcaaatgaccgctcttgcagatgtgatcaagtcttttgctaatatgaatcatcttattgtaaaataaagaaaaagacggttgctgtgtgatcggcaatcgtcttttccccttttacataaacatcacagaatgaaaacatagataaagaaacccttccataaaggtggtgagtacgatcgaattaaataaacggcaagaacaaattttacagattgtaaaggaaaacggcccgattaccggagagcatatcgcagaacagctcaatttaacgagggccacgctgcggccggacttggccatactcaccatgtcaggcttcttagaggcccgtccgcgggtcggttatttttatacggggaaaacgggaaatcagctgcttgcggataaattgaaaaagctgcaagtgaaagattttcaatcgatccctgttgtcatcaatgaaaatgtctcggtatacgatgccatctgcaccatgtttttagaagatgtcggcacgttatttgtcgtagatcgtgatgctgtcttagtcggtgtgctgtcacgcaaagatttgctgcgggcgagcatcggccagcaggaacttgcctcaataccggttcatattatcatgacaagaatgccgaatatcgccgtctgccggcgtgatgattatgtgatggacatcgccaagtatttaattgaaaaacagatcgatgccctgcccgttattaaagatacggataaaggctttgaggtcatcggccggtttaccaaaacgaatatgactaagatacttgtcagtttatcagaaaatgaaatcatataagcttgaaaactaacggggggataacatggacaatcgcatcatttatgtagtatcagactcagtcggagaaaccgccgaactcgttgtaaaagcctcgctcagccagtttaacggctcagccgatgatacgcatatcagaagaataccttatgtggaagatatcggcaccattaatgaagtcgtgtctctcgccaaagcggacggcggcattatttgttttacgctcgttgttcctgaaatgcgcaaatacctggttgaacaagcggaaaaagcgaatgtgctgtattacgatattatcggtccgctcatcgataaaatggaatcggcttacggtttgaccgccaaatatgaaccgggccgcgtccggcagcttgatgaagattatttcaaaaaggtcgaggcgatcgagtttgccgtcaaatatgacgatggcagggatccaagaggcattttaaaagccgatatcatcctgctcggagtatccagaacgtctaaaaccccattatcacaatatcttgcccataagcgtctgaaagtggccaatgtgccgatcgttcctgaggtcgacccgccggaagaactgttcagcgttgatccgaaaaaatgcatcggcttaaaaatcagccctgataaactgaaccatatacgtaaagaacggttaaaatctctcggcttaaatgacaaagccatttacgccaatatcaacagaattaaagaagagctggagtattttgagaaaatcgtggaccggatcggctgccaagtcgttgacgtttcgaataaagcagtcgaagaaacagcgaacatcattcatcatctcaaaacaaagggccgataactcaggacgctttatcctgggtttttgggtatgcaaatagggaataaacaaaaaggatggcatcttcgcgaagtttgtattataataaaaaattgtgataaaatgtttatttttaggtttaagcttcgtgtgatacgaataaactattatgggtaagatgtcaagaataactcccggaaatttttcgacaaagctcaaaatagatccgcagtcatggagcatatgcgatttcgcttgtttttatgcaggagattgatggagggatggagaattagtcttctaaatgaaaaagaaaagacgatttttgtcgatgcagacgcatgccccgtaaaagaggaaataatgctcattgcatcgcaattcagcgttcgggttattttcgtcgcatcatttgaacactaccagctttccagaagcaaagacgagaactgggtatacgttgatcctcataaagaagcggcagatttatatatcgcaaaccatgtgagatcgggagacgtcgtagtcacgcaggatatcggtttagcatctcttttgctgaacagaaatattgccgtcttatcggaaaggggccgttcttatactgaagacacgattgacttcgctctgatgagccgtcatatgtcaggcaaaatgagaagaagcggcattcattccaaaggacctaaaaaattaaataaagaagatcggaatcgatttgttaccctgcttaaaaaaatcctgtcgaatgatgaagggatttcaaatcaaaacatcgaataatgtacgacggagtgttataagatgggaaaccgcataccagatgaagtagttaatcaggtgcagcagtcagcagacattgttgaagtcataggtgattatgtccaattgaaaaagcaaggccgcaactactttgggctctgtccgtttcacggggaaaacacgccctcgttttccgtctccagcgataagcagatctttcattgcttcggatgcggagcgggcgggaacgttttctctttcttacggcagatggaaggctattcatttacggaagctgtttctcaccttgcggataaatatcagattgatttccctgatgatataacgattcactctgcatccaggcctgaatcttccggagagcagaagatggaggaagcccacgagcttctgaagaaattttaccatcatttgctaataaatacaaaggaaggccaggaagcgttagattaccttttatcaaggggttttacgaaagagctcatagatgagtttgaaatcggctacgcgctggattcctgggatttcatgacgaaattcttgaaaaagcgcggttttgaggaagaaatgatggaaaaagcgggtctgctgatcagaagagaagacggcagcgggtattttgaccgtttcagaaacagaattatgtttcccattcatgatcaccacggagccgtggcggctttttcaggaagggcgctcggaagccagcagccgaagtatatgaacagcccggaaacgccgctgtttcataaatctaagctgctgtataactttcataaggcgcgcctgccgatcaggaaagaggagagagccgttctgtttgaaggcttcgctgacgtcatatccgccgtcagctcaggcgtaaaagaaagtatcgccacaatggggacgtcgctcaccgaagagcatgtgaaaatcctcagaagaaatgttcaggaggtcattctctgctacgattcggataaagccgggtacgaagctacgctgaaagcggccggcctgctccagaaagccgattgtaaggtaagagtaagcatgctgcctgacgggcttgatcctgatgattatatcagaacccggggcggagaaaaattccggaccgatatcattgatgcaagcgttacggtcatggcttttaaaatgcaatatttccgcaaagggaaaaacttatctgacgaaggagaccggctcgcttatatgaaagaagtgctgaaagaaatcagcgctctttccgggtcgcttgagcaggaaatgtatgtgaagcagctcgcctcagaattttctctttcggtagaatctttgacggaacagctttccatctacgccagacaaaacgcccccggcgacaaaaacgccgaaccgcagacaagacgggcccgggtgacgactaaagcgaaacggcgccgtctccgtcccgcctatgagaacgcggaaagacttctgctcgctcatatgctgagagaccgaaacgtcatcaagaaagtgattgagcgtgtcggctttgaatttaacattgacggacatcgtgcgctggcagcatacctgtacgctgtttatgaagagggtgctgacatgacgccgcagcatcttatggcgagaatgcaggatgaggaaatcagccagctgctttcagatatagggatgctccaagtaaacgaggagctctcagaggccgagttatccgattacgtaaaaaaagtgttggatcaccgaaaatggtcaatgataaaggaaaaagaagcagaaagagcggatgcggagaggcagaaagacttcgtgaaagctgcgtctctggctcaagaaattgttgcattgaaccgatcattaaagtaacaacaaatagaggcttgcgttctgattggcaatgattccttgcggaggagcaaatagatcgcttaacctcatcatgaattgtcattattatccgcagccctgcatgctgaaaaagagagaaggcttccgggtcggataagaaacataccgcttttagaattcgttgcaagctttggaaggagggatccataatggctgataaacaaacccacgaaacagaaacagaacttacattagaccaggtaaaagagcagcttactgaaactggaaaaaaacgtggcgttttaacatatgaagaaattgctgaacgcatgtccagctttgaaattgaatcagaccaaatggatgagtattatgaatttttaggagaacaaggtgttgaattaattagtgaaaatgaagaaacggaagatcctaatattcaacagcttgccaaagccgaagaagaatttgaccttaatgacctcagcgtaccgcctggcgtaaagatcaatgatccagtccgcatgtaccttaaggaaatcggacgggtaaatcttctttctgctaaagaagaaatcacctacgctcaaaaaattgaagagggtgacgaggaatctaaacgcagactggctgaagcaaaccttcgtttagttgtcagcattgctaaacggtatgtcggccgcggcatgcttttcttagacttgatccaagaaggaaacatgggtctcatgaaagccgtcgagaagtttgactaccgtaaaggatataaattcagtacgtatgcgacttggtggatcagacaggcgattacacgcgccatcgctgaccaggcgagaacaatccgtatcccggttcacatggtggaaaccattaataaattaatccgggtgcagcgtcagcttcttcaggatcttggcagagagccgacaccggaagagattgctgaagacatggatcttacgcctgaaaaagtccgtgaaatattaaaaattgctcaagagccagtttctttagaaacaccgatcggtgaagaagacgactcacatctcggtgattttatcgaagaccaggaagcgacatctccgtcggatcatgcggcatatgagcttttaaaagaacagctggaagatgtgctggatacgttgacagatcgtgaagaaaacgtgctgcgtctccgtttcggtctggatgacggacgcacaagaactttggaagaagtcggcaaagtgtttggagtaacgagagagcgtattcgccaaattgaagcaaaagcgcttcgcaaattgagacatccgagcagaagcaagcgtctgaaggattttctcgaatagaatggaacgggtctttttgatccgttcttttttatgtataagatatatggataatatacctttattttactggataagcatatgttttgcaaatgagtttggaaaaaatgcggcatgtcctgaaaggggggaaatgagacaagtttatttatattctttattgtaagcgtatacaattcattatacaatagaataaagataattttgtggtaagcaaaacagttatttttgctttttgtataaattgtgaaatcattgaaattgctgagcaagaccatttactttttgtaaaaataagttagaattagaagtgtttacatagggggagaatgaaaaagggggatggagatatgaagtggaatccgctgattccttttttgctcattgcagtgctgggaatagggctgactttctttttagctgtaaaaggcaatggagatgcgcatcagatcgcaagcggcggtgaaagcaaaaatgccgagaaggaaactgcaaacgcttcacctgaagagatttataaagccaactgcatcacctgtcacggagaaaactatgaaggtgtgtcagggccgaacttaaaaggcgtcggcaaaagaaaagatgtcgctgagattaaaacaaaaattgaaaaaggcggcaacgggatgcccgcgggccttgtgccggccgaaaagctggatgacatggcaaaatgggtttctgacattaaataaagctttaccggtccctatataaaagacatatgaaaaactctatccgccgcttggattccgggcggtttttttatatgatagtaaaggaaaaagaacctgagaaaagttgtgatattgtgaatgaaatgaagttatcgaaaagattgcagtctgtggcggaatatatccctccgggtgccctggttgctgatatcgggtcagaccacgcgtatcttccttgctatgccgttttgaatcatttggcaagccgggcaatcgccggtgaaattacagacggaccgtttctatccgccaaacagcaggtggaaaaactgcacttaagcactcttatctccgtaaggaaaggtgacgggctgagcgtccttgaaaaaggagaagccggcgccattacgatcgctggcatgggcggagcgctgatcgctcatattttggagtcgggaaaaacgaaattgacagggcgtgaacggctgattctgcagccgaatattcatgccgttcatataagagagtggctgtatcaggaaggctatgaactgcttgatgaagtgattctcgaagaagacggaaagtgttatgaaatcctcgttgcggaaactggcgaccgtgatgcgccttatcgggatgtgccgatggctgtcggaatgcttgcgggtccgtttttgttaaaagagaggaatgaagtgtttcttcggaaatggagccaggaacttaagcatactgaacaaatttatgaacagatcagccgcagcgcaaagcatgaaaatcatgaaaaattagctgaattgaaagagcggatttctctgctgaaggaggtaatcggacatgcctaaacatgtgaacggacaggaaatcatccagctgtttgaacaattttcaccgaaggcttatgcggtggaaggagataaaatcggactgcagatcggtacattgaataagccggtgaaaaatgtcatggtgacactggatgttttggaacaaacggtagatgaagccattgagaaaaaagttgacttaattatcgcccaccatccgccgatttttcggccgcttaaacagatcaccactgatcagccgggcggaagactgattgagaaatgtataaagcatgatattgccgtatatgcggctcatacgaatcttgatgtagcggacggcggtgttaacgatctgcttgccgaagctctcggcctgacagacactgaagtgctcgtcccgacatattcggacccgatgaaaaaacttgccgtatatgttccgaaagactatgaagaagctgtaagaaccgcactcggcaacgccggagcgggacatatcggcaattacagccattgcgcgttctcttctgagggaatcgggagctttaagccgctggacggggcagacccgtttatcggacagacgggagagctggaactcgtccatgaagtgagacttgagaccgtttttccggcaagtatggagaaaaccgtcgtaaaagcgctgaaaaaaagccatccgtatgaagaggtggcatatgatatttatccggtggagcagtctccgcttgaaaaaggcctcggccggatcggaaaacttcagcaggacatgacgcttgaagagtttgctctgtttgtgaaagaaaagtttgacgttaacggagtccggatggtcggagagcgaaacagcaaggtgaaaaaggtcgcggttcttggcggcgacggaaataaatatatttatcaggcaaagcggaaaggtgcagatgtttacgtgacgggcgacctttattttcatgtagcgcatgatgcgatgatgatgggattaaacgtcgtggacccggggcattatgctgaaaagatcatgagaaaaggcacggctgagaagcttacggcaatggccggagagaaaaactatgacgtgcgcattttcgcttccgaaacagatacaaacccatttaccttcttataaaaaaactgaggccccgggcctcagttttttatttttactttcggaagaatttttttgagcggcacactgtgttcaagctgccatgtcgattcatcgttgtggtcaaactgctctaaaaagcggatgacttcctttgtaatcggtgtcggtgttgatgcgcctgcggtaacggcgacggtattgacgtctttcagccattcgagcttcagttcactgatgtctccgattcggtaggcttttgttccggcgatttcttctgacacttgagccagcctgttggagttattgcttttcggatcgccgacaacaatggttaagtccgctttttttgcctgctctgatacagcttcttgacgaacctgtgtggccaggcagatttcctgatggtattccacgtgcgggtacttttctttgactgattccataatatcgtggacgtcccactgggacattgtcgtttggtttgtaacgattaatttctcagcctgaatatcgagatttctgacgtcttcttctgtttcaacgagatgaacgatttcaggagcgacgccgacggctccttcaggctcggggtggccttttttgccgatgtatatgacatgatagccttcagcttttacttttcggattaagtcatgtgttttcgtgacgtccgggcatgtggcatcaatcgtaacaagccctttttcctcagcggcttttcttacttccggagataccccgtgagccgtgaaaataacggttcctttttccacctgctttaaaatctccagacggtttgtgccgtcaagcgtgtaaatgccgtcttcctcaaacgcatctgtgacatgcttattatgaacaatcattccgagtatatatataggtcttggcagtgttttatcgagtgacgcgtttttggctatgaccatggcatcaacaacgccgtaacagtagccgcgcggcgatattttgataacgtccaatgtagatgtcctcctatcaaaagtgagtgtagaggcaatataaaaagccgtagttaaacggctcaaatcttgcattcttctgatctcattatagctaatctttcgtgagatatcaaagaatgttaaatatataatttcggctttgatctgcccgatgttctttttggacgcggctgttccgctgagtctgcctgtgcggcgtctttttcttttgaagcggatgctttttcagacgtcttctttgatgtgttggatgaggcgtctgatttgttttcatcttctgtttcatctgttttttcagcttcatcctttttatcctgttcgtttgtttcttttgtctcgtcagattcattctcatcatcgctgctgcttaattggctgtaaagcttcatcatggcgggcagactccgtactaaaggaccgtactgctgaatcatcggtgtaacctgctgcgccacgccgagcaccttctgaacgttgccgagcatgctcgacagggatgccggacttgccaggttctgtattccctgcagtcctgcacctgctcctccgctggccgccgccggtgccgacgcggcagcgcttcctcctcctgaaccgggtaaaaaacgggaaagcatcccttttaagccccctccgccgcccgtgcctgcgtttctcaggcccgctccggcaatctgctgctgagggaaaagctgccggccctgctgcatcagctgccggcccggcaatgacggtcttcctcccatcatcatacgcggattcatcaacggccggccctgctgcgccatatttctcatcggctgctgtggaaacatacttgtacctcctttctgtctctctgctattacaatatgcatcggagggggcatttgcttttctgtctcgaaaacaggattcccccaagacatggtgtttttaagtaaaatcggttataatgtgatgatggacacagaatgtgccgctttaaggagctgggaaaaatgaaagaaactaaatttgatggatacaacttaaaaccgtttattatagatgcagttcaccgccttggtttttatgaaccgacagatattcaaaagcggctgatacccgccgtgctgaaaaacgaaagcgtgatcgggcagtcccagacggggacggggaaaacccacgcctatttattgccaattttgaatcggattgatccgggttctgatacggtgcaggctgttatcacggcgccgacgagagagcttgccaatcagattcatcaggaagcgctcaaaatcacacagggtgcggaagatgagccgatccggacaaaatgtttcatcggagggacggacaagcaaaaatcaattgataagctgaaaacacagcctcatctcgtcgtcggaacgccgggccggatcgcggatctgattaaggcgcaggcattgaacgtctataaagcgcagtctctcgtcattgacgaagcagatctgatgcttgacatgggctttttagaagatgttgattatatcggatcgcggatgccggaagaacttcagatgcttgtgttctcagctacgattccggaaaagctgaagccgtttttgaaaaagtatatggaaaatccgaagtacgcgcatgttgagccgaaaagaatcacagccgaaaagattgaacatgttttggttccttctaaacagcgtgataaagacaagctgctttttgatatgatgtctcatctgaatccttatctgggcattgtgtttgccaatacgaaaaacacggctgaccatattgcgaaatacctgactgaaaagggcatgaggatcggtcttctgcatgggggattaacgccgcgtgagcgtaagaaggtaatgaagcagattaatgatctggaattcacttatgtcattgcgacagaccttgcggcaagaggaattgacattaaaggcgtaagccatgtcatcaactatgagcttccggacgatctggatttttatgttcaccgcgtcgggagaaccgcacgcgccggttcatcaggccaagcactgaccatttatgagctttctgacgaagatgcgctcgtaagactcgaaaagatgggtattgtgtttgactatgcggagcttgtaaacggcgaatggaagaaaggcgatgaccgccaccgccgcaaaaaacgcaaaaaatcggagaatgaggccgaccaaatggcgaagcgcctcgtgaaaaaaccgaaaaaagtgaagccgggctataaaaagaaaatgagctacgaaatggaaaagataaaaagaaagcagagaagaaacaaatctaacaaaggaaagtaggggactcgggttgctgaaaataggttcacacgtctcaatgagcggaaaacatatgctccttgccgcaagcaaggaagctgtttcgtacggggcgaatacatttatgatctatacgggcgctccccaaaacacgcgccgcaaaaaaattgaagacttgaatatcgaagcgggccgcgcccatatgaaggaaaacggcatcgatgaggttgtcgtgcatgcgccgtacatcattaacatcggaaatacgacaaatccggcaacgtttgagctgggtgttgattttctgcgttctgaaattgaaagaacggcagcgatcggcgcgaaacagatcgtacttcatccgggagcgcatgtcggagccggggctgagacgggcatcaaaaaaatcattgaagggctaaacgaagtgattgttcccggtcaaaacgtgcagattgcgctggagacaatggcgggcaaaggatcagaatgcggaagaagctttgaagagctggccgagatcatttcgggggttacgcataatgaacatctatccgtctgctttgacacttgccacacccatgacgccgggtatgatgtcgccaatgattttgacggtgttcttaacgagtttgataaaatcgtcggcatcgatcggataaaagtccttcatgtgaatgacagtaaaaatattaaaggcgcccggaaagaccgccatgaaaatatcgggttcggagagatcggttttgacgctctgcagtacatcgttcatcacgagcagcttgccgatattccgaaaatcctcgaaacaccgtatgtaggcgaagacaagaaaaataagaagccgccgtaccgttttgaaatcgaaatgctgaaagaaaagcagtttgatcaggagcttcttgaaaaaatatcagctcaataaaaaaggagggggaattgcccctccttttttaccccgagaattgattgaaaagttcgtcaactttccgagccgtttcttttgaggttatcgtttccacttttttcagcaggcgaagccgctcctgttcatcaaaaatattgatgttttttccttgcatcagagccgctacctcagccgcttgacttctcgtaatgctgatgccgtattgcttggaatatttcagaagatcgtctgcagtgacttgattgagccgctgcaaaataattctttgtattaaaatcatcgatactttcacctctttagacataatgtattgagcaaatcattaaaatgttacggcttttaatggtaaaatgaagttgcttactgtttaaaatagttattacaggaaaggagattttatgaccccaaataaacagcataaaagagagtcatttttacactttatcttcagggtcattatgattctgatcggggcgggttcagccgctgtaagtattgaattgtttctggtccctaataattttatcgacggaggcattatcggtgtttcattaattttagaccacctctttatgtccaatcccctcctcaatttcgccttattcgttgtgttactcaacattccatttatgattttcggatataaatatatcggaaaaacatttctcatctctactgttatcggaattgtcggtttagctctgattgaatcctccttgcaccatgtggaggccattacgacccagcctattttggcgacggtattcggcgggcttttgctcggtttcggggtaggccttgtcatccgaaacggaggctcgatggacggtactgaaatactcggtatccttctcacaaaaaagctgcccttctcagtcggagaattcgttatgctcatcaatgtgtttatttttatttgggccggttttgtgttcggtccggagcaggcgatgtattctttcatgacttattatattgccatgaaaacgattgacgccgtcatccaggggcttgatgaaacaaaagcggtcattattgtggcagatcagtatgcggaaatttcagacgcaatcttgcatcggcttggaaggggaaccaccaagcttcagggaaaaggcggatatacggatgaatccaaagaagtcatttacgcggtcgtgacaaggcttgaagtgactaaattgaaatccattgtgtttgaaattgataaaaacgcctttattacgatcatgaatacccatgaaacgaggggcggtaagttcaaaaccgcgattcactaggctttcatttacttttcatcattttataggtataatttgatacatcataagaaaatggcctgctgttcagacagctgccattttctttttggagcgataccgtgttgtaaaggggaggtcctcatgaacgtacaagaagcgttgaacctgctgaaagaaaaagggtataaatatacgagtaagcgagaagacatgctgcagctttttgctgattctgataaatatctgaccgccaaaaacgtgcttgccgcattaaatgacgactatccgggactgagttttgataccatatacagaaatctttcgttatatgaagaactcggcattttggaaacgacggagctttccggagaaaaactgttccgttttacatgctcttatacccatcatcatcaccattttatctgtttaacctgcgggaaaacgaaggaaattgagtcctgtccgatggataagctgcacgatgatttggaagggtatgaaatcagcggccataagtttgaaatttacggcacctgtccggcgtgccgataaaaaacctcctgctatatacaggaggtttttttcagcttttaacatgctgaaagctgtgtttgtttttattaatccaggcgacggcttcaagccaattctgcaccctgataatattggaatcgatggggagctgattatatggggagttaaaaaggataaccggaatgcctgcttcttttgcgatcattgtcgcgttgccgtggtgatcttcgaaaaataaatcaatgccgtgttttttgacagcttccactttgtgatggcctccgacaagctcaatgtgatcgtaatgaatgtcccggtttgcaaaccagtccagcgtaacatcttctaagtggccgcgtcttgccgtaatgtagataagacggtgctcttctttcagtccgtccagtgcctgcttggcaaattccgcgagcttcgcttctttatatatggctgcttcatgaacgttcatccattcccaaaattcctcgtctgtaatgttcaaaagcttcgtcagatcataatcagtcatatcatccaaggtaatggaaagatgaaatgagcggtttaaataagggacaaatgtatcctgtgccgtaactgtgccgtcaatatctatacctaaccgtaacatgtccacactcctataaattcatcccttcaagtgtaacataaacaattaacaataccagaaaagtttagcaaacatgaatccgtaaaaaacgcggaaactaaaaaagctcctttcataaaagaaaaagggggaattgaaggtggcatacgattacgaaaatcgaaaaggcaacgactattacgtggatcatggatcggaaggaaccgatatcacgcgtgatgtttattcagaagaaacagcggccgaaatctcagagccatatcgtgcttctgaccgggcagcagaccgtgatgataatcgggacggagtaagtgaaggccgggggatagggtatgcagcattggctatttctatcatttccctgtttgtgctccctgttttattaggggcatgcggcattatcgtcggctatatcgccagaagaagaggagcaggcgctttaggcggatgggcgatgggaatcggtattgtttcccttgtgcttggcatcttcattacaccgtttttttaacacaacgcaaaaaaaaagcttggcggaatatccgtcaagctttttgtgtttcttgttctgcttttgctttttccgcttcaagctttgcatagtgttcttctgccagcttgtcgatttcttttttcagctcttcgaccattgtttcttcagggactttgcggacgatttggcctttgcggaaaagaagtccttcgccgcgtgcgccggcaatcccgatatcagcttctcttgcttcgcccggtccgttaacggcacatccgagaaccgctactttaatcggcgctttgactttagaaatgtattcttccacttcatttgcgatgctgatgagatcaatttcgatccgtccgcatgtcgggcatgaaataagcgtagccgcgtttgaagcaagaccgaatgatttcagcagttctctggctacttttacttcttcaacaggatcggcgctcagagagatccggagcgtgttaccgattcctttgcttaaaatcgctccgagtccggccgcgctttttaccgttccggcaaacagcgtgcccgattctgtaattccgaggtgaagcggataatcaaatgcttttgacgctttttcgtatgcttctatggcgaggttgacgtcagacgctttcatactgacgatgatgtcatgaaagtcaaggtcttccaggattttgatatgatgaagcgcactctcaaccattccgtcagcagtcggatagccgtatttttctaaaatgcgcttttccaaagatcccgcgtttacgccgatccggatcggaattcctttttctttcgccgcttttacgacggcttccactttttcgcgacggccgatgtttcccggattgattctgattttgtcggccccgccctcaattgcttttaatgcaagcttgtagtcaaaatgaatatcgacaacgagagggatggaaatttgttttttgatgtcggcaatcgcgttagcggcgcgttcgtccggacatgccacccggacaatttggcagccggcttcggctaaacggttgatttccgcaactgttgcttctacgtcgtgtgttttggtcgtcgtcatactctgaatgacgacttcgttatttccgcctattgttaaaggtcccactttgacgggacgcgtttttgtacgatgtgtgatttcactcacttgtcaatcgctccttaattgtagttaccgcttttgcaggctgagccttttacatgtcaggcaacttctatttacatgttatattgtaacagtgtatttgccgaactgacaagaaattaacgtttaattgcggtagacggggaatttataagcggtgcctgcctgaatggcgtttgcttttacattcggattcagcgcttcaaaatcttgtgcaatatcatctggcgctttatgtgcgccgactatcgacatcaccgtatcgccttttttgaccgtaaccgttctgtatgaagcttcctgttgggctggctgtgccgccgctgcgtatgctggaaggtcttgagaagggatcgtgccgattttaagatcgtaaaagataatgaatatcacaaataaactgccgaatacaaaagtaagccgcttcattccaaccgcctcccgcatacatttttacttcattgtatgcttgtcccattttgttcatgacaaaaaagaagaccgccgggggcagtctttgttatacatctgttttacttcgcggtatctcttttaagacgaggaaaaggatgataaagtttacaaaccaattcactaaaaattcactcggcaccgtaataacaagcgcgcgcatgatcgtaaagaatacggtcgaaagtgtaatggaataagccgaaagcttccagagctgctggtaattcaatgtctttctttgcgcatttttcaatatcaggccgatgacggcgagaaatgatacttcaatgaatttgcctgccgctgtcatgatgaacagcaaaacggacaggacggtgacgatcattgttttattttggtttaatgctgatatgatttctttttttgtgatatcggcaggcatcagcgaataattcatttctgtcgcttgtccgtctacagcaagcaccattttatttttcaaaatgccgatcgcattttgtttcgccgctatttgtttcgcgccgtaagcatctgtgggatcaaagacgatgacgaacccgttcgcttccgtttccttagaggcggacgctttcgtctgcaattctccgtttgaaatgctgaaatcagggaaatctttctttaacacggttttgaaaccgttcattgagtttacggtgccggagcaaaggtaataagcgcttggcagcgtaaaaaggacagacagcaaaaatacataaaggatcgcttttcctatcccctgaaaccgtgtttttgcaatatctgccggagagtatgtacttttcaataaagccgtaaatatgttcaacatcttcacttcctagcctaaactggtatatgttgcttattgtatcgttcacaggggatgaacacaagtgagagtatttaaagcggtgataaggaatcatacatataagataaagcgggaagcggtgatcgcccgcaaaacaaaggagggtgtttttgtcatgagtgttttgtattggctgattatcattgcggtcttcatcattgcttttatcgggcttgtatatccggtgattccaagcgttatttttattgtggccggttttcttctctacggatttttgttttccttcagtccttattcttacctgttttggctcattgaggcggtatttgcggccgttttattcgcagctgattatgtgtcaaatttacttggcgttaaaaggtacggaggaagcagggcggcaatctggggaagcacgatcggattattgatcgggcccttcgttattcccgtggcaggcattatattagggccgtttatcggtgctgtctgcgctgaggtgtttgttcatcaaaaggatatcaagtccgcggcaaaagtggggctcggctcgttaatcggttttttaacaagcgtggcggcaaaaggcgtcattcagctctttatgatcggatatttcttatggacggtgctttagaaaggtttaatttcggcagggaacggataaagtgtaatatgtctgctggaatcgccggattgtgagctttttcattgattaccatgctttcttttgttacattgagattagaaaagttcgcgttaagcggcatttcagtacatatatttaaaggaggaaaaaaattatggcttacaaacttccagaattgccttacgcttatgatgctttagaacctcatatcgataaggaaacgatgacgattcatcatacgaagcaccataacacatacgtgacaaacctcaacaaagcgatcgaaggatcagcgcttgcagagaaatctgtagatgagcttgttgctgatttgaacgcagtgccggaggacatccgcacagctgtccgcaacaatggcggcggacatgccaaccactctttattctggactcttttatctccgaacggcggaggcgaaccgactggtgagcttgctgaagagatcaaaagcacgttcggaagcttcgatcaatttaaagaaaaattcgccgccgcagctgccggccgtttcggttcaggctgggcttggcttgttgtaaacaacggcaaacttgaaattacaagcacgccaaaccaagattcaccgctttcagagggtaaaacacctgtcctcggtcttgatgtttgggagcatgcgtactacctgaactaccaaaaccgccgtcctgattacatttcagctttctggaatgttgtgaactgggatgaagttgcccgtctttacagcgaagcaaaataaatagttcgatcaaacaaggtctcccgcgggaggccttgtttttttattgactttgaatccttttacatatctcagtttgagtgagacaaactaatgtgtagtaaaggggagtcaatgatgagcaaaataaaaaaaattatcggcgacatcgaaataaataaagggctgctgctgttattgacgattggcggcctttactcattgggcatcgcgctgtcaaatacatttgtcaacgtgtatttgtggaagcagtcgggaaaatttattgatttggccatatacaatttgtcggtcgtaacgatgcagccggttacctttctgctggccggccggctggctaaaaaaatcgacagggtgtttattctcaggttcggcgttatctttttggccgctttttatttaagtgtgctgcttgccggagaaactgcggcttcccgtctcgttttgataggggccgtgctcggagttggatacggcttttactggctggcttttaatgtgctgacgttcgaaattacggaaccggaaacgagagatttttttaacgggtttttaggcattttgtcttcatcggcgggcatgatcggtccgattgtggccggatatgtcatttcaagacttgaaaacaatacgggttatacaatcattttcagcctgtcgctcggcttatttgcccttgccgtggtcatgagcttttttctgaagcggagggagtcgaaaggccggtttatgctgaaaaaagtttttgatgagcgccacacgaatctgaattggcgccggattaccaacgcgcacttttttcaaggcttgagagaagggatttttgtttttttaatcagcgtttttgtattcattgcgacaaacagtgagctggcgctcggaacattcggtctcgtcaattccgcggtttctttttttgcctattattttgcatcaaggctcatcaaaaaaagagctcggaaaaaggcgattcttatcggcggattgatcttgtacggtgccctgtttcttatcatttttaaaatgagcttcacgacgctccttttgtacggagtgtttattgcgatcggctatccagttctgctcgtgccgtatgtctcgcttacatatgatgtgataggccgggcgcggcttgccagaaaagccagaattgaatacattgtgctcagggagttatttttaaatgcgggcaggatcgtttccatcctttgtttccttgtaatcgttacattattcaaggaaaaagtgggaataccggcggcgctcgtgctgctcggagccggccatccgctgatttattactttataaaagacatcagactggatacggaaacttctgatgaaacagtagaagaagaccgacaaaaacaggcggcggaaccgaattttataaaaggagaaagataaaagggttatctgtagaaaaatatcgaaaaaacctttagaatgaaaaatgacacctgaacagaaggtgtcatttctttctgtaaataagaaaaggtgatgtcatgaggagaaataaaaagaaaatagctgtaaacaaagaaaagaaaaaatcactgccgatccggcttaattttttgtttttggccgcgtttcttattttcacttggattatcgtcgagcttggcatcaagcagatcgttcagggtgatgattataaaaacgccgctaataagcaggaggagtctgatgtcagcacggcggttccgagagggaaaatatacgaccggaacctaaatcccatcgtaacgaataaagcattaaatgcgattacatatacacgttcagcctcaaccacccaggcgcagcgtttaaaaatcgcaaaaaaactgtcgggtatgattaaggtaagcaccaaaaaggtgactgagcgggataaaaaagactattggatgttaacgaggcctgatgaagcgaaaaaactgattacggccgaagaaaagcaaaaagctgaagacaaaaaactgtctgaagatgatttatatcagcttcagctgaaacgtatcacagacaaacagctgaatgagctcacttcaaaagatatgcagatccttgcgatcaaaaggcagatggattcaggctactcactgacgcctcaatacatcaaaaatgaaggggtgtcggcaaaagaaatggccgtcgtcagcgaacatttagatgaactgccgggagttgacgtgacgtctgactgggaacggtcttatccttataaaagcctgatccggacattgctcggcagtgtatccagtgcgaacgaaggtcttccttccaatctgctggatcactatctgtcactcggctacagccggaatgacagggtcggaaaaagctatttagaatatcaatatgaaagcctgctgcagggtcaaaaagagaaagtgcagaacttaaccgactcatccggaaatgtcacgggcagcaaagtgatttcaaaaggacaggccggcaaagaccttgtattatccattgatatggacctgcagaaatccgttgaaaaaatcattgagaaaaatttaagatcggcaaaagcgagaccgagcacgaagcttcttgatcgggccttcgtcgtcatgatgaacccgaaaaacggagaagtgctgacgatggccggcaaacagattacgaatgatcatggaaagtacaaaattaatgattatgccctcggcgcaatgacttcctcctacgcaatgggatcggcggtcaaaggagcgacggtgttgaccggactgcagacgggcgcgattaatttgaacaccgttttccaggatgaacctatgtatttcaagggaagtaaaaacccgaaaaaatcatggacgaatttaggtcccgtagatatccaaaaagcgcttcaggaatcatcaaacgtgttcatgttcaaaacggcgattgctgtcggtaaaggggagtacaaaaaaggccagtccctgccgcttgatatgaaggcattcgatactttcagatactacttcaatcagttcggactcggagttaagactgggattgatcttccgaatgaagcaaccgggtaccaagggacacagcgaatttccggtcttctgttagactttgccatcgggcagtatgatacgtttacaccgctgcaaatggcgcagtatgtatcaacgatcgccaatggaggctatcgtttgaaacctcagcttgtaaaagaggtcagacagcctgattcgaaaaaaggaatcggagccgttgtagagtctgttcagcctcaagtactgaacaagattgatatgaatcatgcagacattaaagaagtgcaggcaggtttcagacgtgtcatgacaaaagggacagccgcaactgattttgcgacggcgacatacagtcctgccggtaaaacgggtacggcgcaatctttctatgacggtcctgacaaatcagagacgggtgaaggaacgtataatacgactcttgtcgcgtatgcacctgctgataatccggaagtggctatttctgtagtcgttccttgggcctatattaattacagcgatcgatattcgattacgaatgatataggaagagcagctctggacaaatactttgagctgaaaaagaaacaagaagataataatacgaagcagaaaaacgaagataaaattcaggaagacgctgaaaacggcaatacaagcaactaacagaaaaacgctcacaacctgtgagcgttttttttatacaaaaaaacatccggatttacaaaaccttaacacttgatttatacgcattttacaagaaccctttactctatacgtgtaggacaaattacacattaaatgcagggggaattcaggaaatgaaaaaaaacaaatggatgcttatgcttctgatggctgctgttatgattgttgctacagcatgcggaaatgcaaaggaaagcggcaagacagacagtcaatctgcaagtgaggataaaaaagcatcaggttctttaaccatttctggttcatcagccatgcagccgttagtactggcagcggcggaaaagtttatggaaaaacatccggatgctgatgtgcaggtgcaagcgggaggttcaggaacaggactttcgcaagtgtctgaaggggcagtgcaaatcggcaactcagatgtcttcgctgaagaaaaagaaggcattgatgcgaaagccctaaaagaccaccgagtagcggtagtggcgatggcggctgcggtcaaccccggtgcgggcgtaaaggatataaccaaaaaacagctgacagacgtctttactggtaaaattaaaaactggaaagagcttggcggtaaagatcaaaaaattacactcgtgaaccgtcctgattcatctggaacacgcgctacgttcgtcaaatatgctcttgacggagcagagcctgcagagggcattacagaggattcctccaatacagtcaaaaaaatcattgcggaaacgccgggagcaatcggttatctggcattctcttatataaacgatgacaaagtaacgcctttatcgatcggaggcatcgaaccggaagagaaaaacgtcgtcacaggcgagtatccgatttgggcttacgagcactcttatacgaaaggtgaagcgtcaggccttacaaaaacgtttcttgactatatgaacagcgatgaagtacagaaaagtatcgtaaaagatcagggctacattccgatctctgatatgaaagtcacacgtgacgcaaacggcaagcaaagctgaggggagggcgggctccccgcctcttcttctttataggagtgtaaacaaatgataaatcacagagaaaaagagtctgtaagcgaacgcttaataagctcaaaacaaaacaggcaattggatgaagtccgcggaagggtggttgtgtctgtgtgtgccgcgattatcattgcggcatcagcggcgatcacaatttttctcggcataaaggggctgcaatctttttttgtaaatggtgtaagcccgattgagttcttaacaagtcagaattggaatccaacccaggcaaaacctgagttcggcgcgctgccttttattttcggatcatttgcggtcacgattctgtccgctctgatcgcagcgcccctcggtattgcgggtgccgtgtttatgacggaaattgcgccgacttggggaaaaaaggtgctgcagccggtaattgagctgcttgtcggcattccgtccgtcgtttatggattcataggtcttacagtattggttccgtttatcggctcttttaaatcaagcggaacgggtcacagccttctggcggggacgatcgtactctcggtaatgattctgccgactgttacatcgatttccgctgatgcgcttgcgtcacttccgaaacaccttcgcgacggttcatatgcgcttggtgcgacgaggtggcagacaatcagaaaggtgcttatcccggcggcgtttccgacattgctgaccgctgtcgtgctcgggatggcaagagcgttcggagaagcactcgccgtacagatggttatcggaaatacaaagcttctgccggaaagcctgcttgatacggcgggaacattaacgacgattatcacgttaaacatgggccataccacatacggcagtattgaaaataatacgttatggtctatggggcttgttcttctcatcatgtcgtttctgtttatattgctcatacgctacttgtcatctaggaggaaagtgtaatgaaccggaaaataacggataaattggccaccggtgtattcgggttatgcgccgctgtaatcgcggcgattttggcaggattgtttttgtacattcttattcacggcgtctctgaaatctccttgcgttttcttacgtcaaaatcgagcgccattgcctcaggcggcggaatacgggatcagctttttaactccttttacattctgtttatcaccatgctgatcacgataccgcttggtgtggggggcggcgtctttatggctgaatatgcgccccaaaataaaatcaccgattttatcagaacgtgtattgaggtgctgtcttcgcttccgtccattgtcatcgggatgttcggcatgctgatgtttgtaaacctgaccggatggggctacacgattatcgggggcgcgctcgcattaacggtctttaaccttcccgttatggtccgggtgacagaaggcgcgctcactgcagtccctaaggagctgaaagaagcttctcttgctttaggcgtatcgagatggcataccgtcaaaacggtgctgattccgagtgcgattccttcaattttaaccggagccattctggcatcaggaagagtattcggagaagcggccgcattgttatttacagcggggctgacaacgccgcggctgaactttacggatttgaacccgttttctgaatcatctcctttcaacattttcaggccggctgagacgctggcggttcatatatggagtgtcaatacgcagggaatcatccctgacgccgaagcgattgcaaacggcggctcggcggtgctggtgatttcggttctcttgtttaacctttctgcgagatggctcgggtctgtcatttataaaaagcttacggcaaattaatcggaaagaggcgaaaacatgattgatcacatcatcagggaacaagcggaacaaacaaagcgtttgccggagtcttcgattttggaagtgaagcatttatcaatttattacggtgacaaacaagcggtaaaagatgtaaacatgaatattgaaaaacatgcggtgacggctctgatcggtccgtccggctgcgggaaatcaacatttttgagacagattaacagaatgaacgatgccattgcttcggcaagaagcgagggagagatcctttatgaagggctgaatattttgggtgaagcgattaatatcgtgtctctcagacgggaaatcggtatggtgtttcaaaaaccgaatccgttcccgaaatccatttacaataacatcacacatgcgctgaagtatgcgggggaacgcaggaaagccgttttggatgaggcggtcgaggaaagcttaacgaaggcggcgctttgggatgaagtcaaagaccggcttcattcatcggctctgtcgttatcaggcggccagcagcagcgcctttgtatcgcccgtacgcttgcgatgaaacctgccgtgcttcttttagatgaaccggcttcagctctggaccctatttcaaacgccagaatcgagacgcttttgacagaactgaaaaaagattattcgattattatcgttacgcataacatgcagcaggcgctgagggtgtctgaccgaacggctttctttttaaacggggaagtggtggaatacgggcagacagaacaaattttcacgagtcctaaagcgcaaaagacagatgactacattaacggaaagttcggatagggggaaggactgtgagccttgtgaaggaagcggtgcacacacagaatttatttgatattcacggcatgaacgtatggtacggagcccatcaggctttaaaagacattacgatcggttttgaggagcggaaggtaactgcgatcatcggtccgtccggctgcgggaaatccacttttattaaaacattaaacttaatgctgcaaatggccccgaatgtcaaagtgacaggcgacatgatctataacgggcgcaatctgctgaaggaaaagacggatgcggcagaattaagaaaacagatcggtatggtgtttcaaaaaggaaatccgtttccccagtcaatatttgagaatgtcgtgtacggtccgagaattcacggcgaaaaaaataaaaagaaactgcttgaaatcgccgaggaatctttaaaagcagctgcgctctgggatgaagtgaaggatcgccttcaccaacaggcgctttcactgtcaggcggtcagcagcagcggctgtgcatcgcaagagcgctcgccaccaaaccggacgtccttctgatggatgaaccgacgtccgctcttgatcccgtgtccacgcggaaaatagaagagctgattttgacattgaaagaaaagtatacaatcgttattgtgactcataacatgcagcaggctgcgagggtctctgatcaaaccgcgtttttctatatgggcgaactggtagagtggggcgatacgggcaaaatattttctcagccggaccatcaaaaaacacatgattatatcaccggaaaattcggataaaaaaagggcccggccattgaccgggtccgttttatatgtctattaaaaaagcctgccggccgtatccatctgaatggacgatgcctgcaagcttttttagcgggttaatgttttgacgatttttttaaagctcatatctgagtcgactttgaaatggccggcgcggatttctttgtggtagcctgcgtcaatgacgtaatcattgaagtctttcgctgaaggaataatcccttctttttcaagaatggatgacacatcagcagtgctcattccgtctttaatcgtcagtttgtatgttacttttttctttttggcgtctgtgttttggtcgttgtttaacgatttttctttagaatcaagcagtttttgatagtcatcccggttgacggagactttgtgctgatcgtcgaggtagctgtttacttctttttctgtcaatgctgttttttcggttttaacggcggctgcctggtcatggtcagtcaaatagaagacagcggcaagaacggccgtcgctaaaatcatgcctgctgcaaaagcctgaatgccccgttttgtcatacgagcaccttctcattatctttaataatggtattgacgtcctcgacagacacgtgctccgcttttgcgatggcttccgcagacattccgttgttatattttgaaatgatttgtttggcgattttttggttaatgccgctgcttttggctttgcggatcacgaggttggtttccagcaattcttcttcaagcaccgtcattttctttttcaacttgtaaatttcctgcatagcggaaagctgaagcgtttctagctcctgttccacgtctttcatcggatctctttgagaatatgagaatgcaataagcgctatactgacgataaacaacgcaataatagcaatttccacgtttaatcaccttctattattaatttgcccttcttttttataccataaaacgccgccattctaaaggaaatagagaaaaaaacggaattttgtcggaaaatcttttttactcggggagcagacggttatttctctatagatttcgtatcagaaagcccttttttgtcctgtttcgtcatattttaccttcttctgacgcaagctcattcagaggatcagaagcgtaaactgatgttttctgcacttaaacaacatttcatgtaaatcagctctagcattccgtccattatagtggtattatatataagtctgaataagtaaatgatatttagtttggagggaaaataatgcgcgttaatattactttggcttgcactgaatgtggtgagcgtaactatatttctaaaaagaacaaacgcaacaatccggaccgcgttgaatttaaaaaatattgcccacgtgataaaaaatctacgttacaccgtgaaacaaaataagctgtttaacacagcggaaaaagctggagctttcaataaagttctggcttttttgtctttcagggaggtttgagaaacgtgaaagcacaaatcagaaccgatataaaagcaaagctttctgacatgacagaaagtgaatgggagaaaaaatgccgcagcatgcgtgaaacgctgttttctttaaaagaatggaaacaggcccgcgtgatcgccgttaccatctcgacacgcctggaaattccgacacggccgatgattgaacaggcctggcaagagaaaaaacaagtctgtatcccaaaatgctttccgaagacgggagcaatggagttccgtacattttctgcgtatgatcagctggaaaccgtatatgcgggcctcagtgaaccgatcgagagtctgacggaaaaagccgcccaaaatgacattgaccttgtgattgtgcccggcgtggcttttgaccgggaaggcttcagaatcggatacggcggaggatattatgatcggtacctgtccggttataaaggccgtaccgtgtcgcttctctttgactgccagctgacagaccgcattccccgcatgccccacgatattccggtcgatatgatcgtgactgaatctgaaaccatcgcttaatcgcataaaaaactttttgcaccggaataattctcgctgtttgacaaacgataggggcaggagggataagatgaaaaaattgttgatctactcattatgcgccgtatctgttttagccgtttaccaaaaccgctaccgtctgatgaacagcgtgctcagccagccggggatcagacggacattcattcatttctttttaaaaataccgtttatcagaaacaaattcattcagcaggcattttaaacaaatcccgttttttaagcgggattttttgcataagaaaacctgccggtaaaaaacggcaggttttctcgtattgtcagctttttttcaggaaaccgagcagaattgagatcataggagaaatgtacaggaaaaaggtaaacggcaggtagtcgacgacggaaacccctaatgcgcttgccataaaagcgccgcttactccccagggaatcagcgggttgatcaaagttccgccgtcctcaagcgaccgcgcaaggtgaatccgcttaatgccgagcttgtcatataaaggtttataagattgacccggaattaagatcgacaaatactgctcacctgtcgcaaggtttacgcctatacttgagaagacggtcgccatgacaagacgtcctttcgtatgcacgccttttatcaatccttgaagcagcgccgcgatcaggcccgttttttccatcaggccgccgagcgcaaaggcgatcataatcagagagactgatcccatcatcgattggagcccgcctctgttgataatgctggccacagcctggtcgccggttttaaacgccgtcccgctttgcagggcggatataaatccttgaatgctgctgtcaggaataaaaacagcagtcagaagccctgcggaaataataccggcggtaagcaccggaatcacggaaacccgtctcacagctaaaatgatcaccaacagaggtgaaagaagcgaccaaggcgtaacgtgcacggcctcttttattccggaaatgaccgcctcaatattttgcgttgaagcggcatttattgaaacagatgaaccgagaatataaaaaagaacgatcgtgatcagcagtgccggaacggtagtgcccatcatatggcgaatatgcttaaaaatcggaatttcgccgattccggcggcaaaattcgtcgtgtcggacatcggtgacattttatcaccgaaacaagctccgcaaatgactgctcccgccgtccattcgagcggaactcccgccgcgcttgctacccctaacagcgcgacgccgattgtactgacagttgtcagacttgagccgacaagcgtgctgataatcatgcaggaaaataatgcggtcaaaagcagctgactcggctgtataattgacagagcgtaaacggtgacggtgggaatggcgccgctgtacatccaggcgccgatcagcacgccgatcaaagccagcacgataatcggctgcacaccgtttttcaatccgctgacaattcctttttcaagactctcccacgagaaaccgagccacaaacctgccagagacagaataatgacgcaaaagaacagcggcatatgcggctctgtatgaaagaaaaacaggcaggaaataatgactgctaacatcaagacaaataaactgatggctgagatgaacgtcagccttttttcttgtttcaaaacaacaccccatcaaactttaatccttttgtgcttttgggcacgaaagtattgtaacagaaaaacgcataaatgagtgtttttttacaattgtgaatatacaatttatgaaaataatacaaggatattttctccaatcgttttttgcttgacgcccggatcagtgatgaaatacgcttatactaagaagaatagaaatggtgaagaagatgaattcattttatgacgtgcagcagctgtttaagtcattcggacatattgtttatttcggtgacagacaagccgaaattgactttatgaaagatgaattaaaggaaatgtacttgtcaaacgtgattgaaagagatttatggcaaaaagccgccggagttcttcagagagaatcggagcggatcagaggcagttaacacagcaggattttaataagaaaaggagattattatggaagatacatggtttgcggggattgatcttggcggaacaaccatcaagctggcctttatcaacatgtacggtgaaattcagcataaatgggaagttccgaccgataaatcaggaaacacaattacggtcacgatcgccaaagcgcttgatcagaagctggaagaactgaacaagccgaaacggattgtaaaatggatcggaatgggagcgcccggacctgtggaaatgacgacgggaatggtctatgagacgacaaatatggggtggaaaaactatccgctgaaagaccatctcgaggcggaaacgggtattccggccgtcattgaaaacgatgccaatatcgcggcgctcggagaaatgtggaagggtgcaggtgacggggccaaagatgtcattttagtgacgctcggaaccggagtcggcggaggcatcatcgtcaacggagaaatcgttcacggtaaaaacggggccggcggagaaatcggtcatatttgcagtatcccggaaggaggagctccgtgcaattgcggaaaatccggctgcatcgaaacgattgcgtccgcaaccggcatcgtccgcatcgcgaaagaaaagcttgcggcggtttccgactcttcgctcttacaagtgcgcgatctgacggcacgtgacgtgttcgaagcggctaaacagcaggataagaccgcgcttgaagtcgtcgattatgtcgcaaaacatttaggcctcgtgctcggaaatctggcaagcgccatgaatccgacgaaaatcgtgctcggcggaggcgtgtctaaagcgggggaaatcctgcggtcaaaagtggaagagaccttcaaaatcaccgcgttcccgcgttctgcggaagcggccgatatttcgattgcggcacttggaaatgacgccggagtcatcggcggggcgtggattgccaaaaatgaatggctcaaacatcaaaactgctgaagaaagtctgcctgcccatatcgcgggcggctttctttttttatctcccctgtcatatagtttttaaaaaagggggatgaacatggcgggaattcgtgtcaaacctgaattgaaacagcatatgaaagatattgcaaaggtgctttcaattgatgaaaaactgttgaaagccgctgataaaacggcggaaagcgatgaattattttgtcccggctttgccgttagcgggcagtcagagggtccgccgcttgagacgctgagcgggctttcacgatacatccggcactgtgaaagcgttctttccgctgatcaatgggtgaaggaagaaaaggtgtacggctctgaatcggtttatgaagaaattgagaaaataacggatgtctttccgtttgtcacaagccgtaaaatcggcagttccgtattgggaaagccgctttatgagctgaaaataggtgcggatacggccgaaagaaaagtccatgtaaacgcctcatttcatgccaatgaatggatcaccacctcggtcgcgcttaaatggtgtaaagaatattgcgcggcattatgcgaaaataaaaccgttttcgggcagtctgtgcttgatatattcagccggacatcattgtcattcgttccgctcgtaaatcccgacggtgttgatctcgtactttacggatgtgaagatttatcagaaaaaaatgaattcctcaacgaattaaatgagcgccgcccggatttccgcgaatggaaggcgaatataaacggtgtggatttaaataaacatttcccatccaattgggatattgaacaaaggcgcaaaccgaaagccccttcataccgtgattttccgggaacggcgccgctcactgaaccggaggcgcaggcgatgcaccggatgataacggaacagccgcctgaccggctgatcgcgcttcatacgcagggagaagagatttactggggatacgaaggatgtgaaccggagcaatcatcccagatgattcgggagtttgaagcgataagcggaaaccgctatcaaggcgttaaaaccattgacagccatgccggttttagggattggtttatacagcagtatggaaaagagggctataccattgagctcgggaagggaaaaaaccctttgccttttcatcagtttgctgatatttatcaagcgacggaaggtattttgtggaggtcgcttgttttttgagacatctgtgaaatttctcatttgtttacataaacaaatatgggacaatagaaaagaatggagggaaggctgatgagatacttggtttgtgttctgctgtccgcattcgttctgtgtttagcggcctgtgaaccatctcatcagcagcaagacacaggcgtttcggcaaaatcggcagaacagaaaatcgttccgctcagtaaaaaggaagcggaaaaaacggaaggatggctggataacagaacaattctgtatacagcacatcatcagctgatgaaatatgatcttttcagcggaaaatccgaacggctctatgaaacaaagggcaatattgtcaatgtaaagatcagccggaaaaaacagctgattctcgtacaggtgacaagcagcggtcagactgagcttgtgcttatgaacaagcaggggaaaagactttatcacaaagcctttaactcttatgagctggagacggcttggaatccgtatgacccgtatcaaatgatgattaccgtttttactgaaacatgggacttcacagcctatacggccgatatgaacaacggcattttaaaaaagagtcccgttcaggccccttttgtccattggacctccactgatgaattccaatatatcaagcaaggaaaaacggaggaagagggtcctttatattcttatgacttgcagacgaaaaaagaaaaaagagtgcttcatcacgtcatctgggctgattcccgcccgggcatgacgattgccgtcagaccaacggatcaatcggacggagacggcgagttctttttccaaaagccggcatccgtgacacaccgctttcctctccaaaaaaagtatgagagcttcgcgccgatggaatatgattacgatcagacacacaagcggttttacatatttaagcctgaaggccgctcttacaatctgatcagctttgacttaggagacgaacgggagcggacggtgctcaaaaacacggaaatggagccgattcagatctctccgaacggggaatacgctttatacggctttacgtatgaccgtctgatttcactgaaaacgggcatgacagaaccaatcataacaaatgaaaaaggagtttgaaccaaatggcaattgcagatgtcacaatcattccgatcggaacaaaaacaccgagcgtcagtgagtatgtagcggatgtgcaaaaaattttggagggttacaaagctgccggcaaaatcaaatttcagctcacgccgatgaacacgttgattgaaggtgagctgagcgacttattcgcagtcattcaggatattcacgaagccccgttccaaaaagggctgcacagagtggcgacaaatatccgcattgatgacagacgtgataaagaaacgacgctggagagcaaaatcaaaagtgtcagcaaacatttgcagcaataaaaaataagcctgtatccattggatacaggcttttaatgtgcagtcggatagccgctggttacaacggtcattacggtaaaccagccaaacacgcccagcgtggcggcggctaacaaaaatcccaggatatttttctgtctgacagcccgcaggactcctaatacagctaataatgcgacaaggccgaagattacaacaagtaacatcatgctcctcctttgtcattggaacctgaaaatctttccatttcattttaaccgttttcattttgtttgtcgatagcgttttcccggccgcatccattgaatcttccccagaaaaccttcataataagggcatatacataaagaggtgatgaaagtgaaatggagacgaatgccggccggtccgattcaggcaaacgcgtattttcttgtcagtgaggatcagtcctgtcttatttttgatccgggcggggaagcggacaaaatcaacaattacataaaagaaaacaatctgaagccgctggccatcttactgacgcacgctcattttgaccatatcggcgcacttgacgaagtaagagacagatgggatgttcccgtctatcttcacaaaaatgaagaaaagtggctggaggactcttccttaaacggatcaggcatattgcggggcatcgccgtaacggcacggcccgccgaacggctcatcgaaggcgacggcattttggacatcgggcctttccatttggagacattgtttacgccgggacattcaccgggaagcgtttcttattatgtgaaggacgcagatctggtgatttcaggtgatgtgctctttcagggaggcatcggccgaactgatttacacggcggaagtcaggacgtattgcttgattccattcatcaaaaactgctcacgcttcccggacatacacttgtattaagcgggcacgggccggaaacggacatccagacagagcaggagcgaaacccgtttatcaatggtttttcactgtaaatgaaaaaagacagaccataatcggtctgtctttttctgttcagtgggttccgccgcccggtgtcataataaaaatagagtagtatgtaaatccggcgaaaaatacggttaagtaagctccgaaaatataaatatacatccgctcagtcagattcaaataagaaagaaatacgaaaaagatcgtctgtccaaaaaacaaaagagaagcgtctttcatgccccctagaaaaaacatgaccgcaaatatccccgtccaaaatcctaacacccggaacatgcgattcattccttatcccctcccgagagtctatctgaagtttattataatagatcggcactcaaaatgtaaacattttcatgattatatttattgtggaatttatgtctttccctgtgttttatatcttatgccgttctctaaaaaagatccgaaaaatctttttgaaatacgtttagggaaaaaaagttcagggtacttatgttaacaaagagacggattatccgagggaggaatttttaaaaatgaaagaacttattttttattcatacccgagctgcacatcatgccgaaaaacgaaacattggttaaaagcccacaatgttgactttcaagagcgacatctattccgggagacaccgacaattgatgaattgaaacagatcttatcattaacgaccgaaggaattgatgaaatattggcgacgagaagccaaacatttaaaaaccttaacctcaacattgaagaaatgactgtaaatgaagtgctgaagcttttgactgagaagccgaaactgctgcggcgtccgattctgatcgatcgcaataagctcgttatcggatacaatccgggagaactgatgaagctgacgaagaaaaaaacggtacatcaatctgtatcataagagaaaaacgaagatccgctgatcaaatatatcagctaatcttcgttttttgcggttgcgggactgggctagctggattcgaaccaacgatcacggagtcaaagtccattgccttaccgcttggctatagcccatcggatgtaattacagtatgtgcgtccggccccgatttatacatacaaagtaatttgaatggaggagacccgtgaaacatttgaatgaaacattatctcgaactttaattgaagaatcaggtgaaatcacacgccagtggctgctcataccaaaatcggggcggccttcagatgatcagaaagcggaaatgcagcaccgtctgttaattgaaatcgttgccggcattttatcggaaaaagaaggcggagaagaggagctgacaaagtgggcgcttcagttcgcaagggaccgggccgtccatgaagtaccggtctatgaaagcgtcacgagctttaaagaattccggagattggtctggaaccgcatacagacatgctgcgaaacgatgtctgagaagcccggggcgaatgcggtattccattggggagagaagctgaacaaagcaattgaccatatgattgaagtatttacagaggaatattataaagtgacggttacacaattaaacgcccaaaaggaaatgattaacgaactgagcgcgccgattatgccgattgccgccggtattggaattttgccgcttgtcggcgaaattgatacctaccgggcaaaaatgattttggaatcggtgcttgaccaatgttcttcactccggctttcttatttatttttagatatatcaggtgtgccgattgtggatacgatggtcgcttatcagattttcaaagtgattgacagcacaaaacttctcggcatagaaacgacaatctcaggcatcaggccggaaatcgcgcagaccgtcgtgaagctcggcatcgatttttctcaggtgaaaacggagcagagtctggcgaaggcgctggcaaaaaacggatttatcgtaaaagaatcattaagatgataaaaagctgaatggccgggagggatttctccctcagctattcagctttgtcagcttcaatcgtcatgatatgatggctgtcgatttcttttaccgtaaatgtgtagccttcaaaatcaatggtgctcccgggcttcgcgtcaatatgctgagtaagaaaccagccccccagtgtatcgacttgatcagccgtaatctctgttccgagtaaatcattgacgtcactgatcagcaatttggcgttcaggagatagcggttcttcccaagcttttgaacggaaggtgtttcgtccgtatcaaattcgtcgcggatttcgccgacgatctcttcaatgatatcttccgccgttactaaccccgcggttccgccgtattcatcaatgagaatggccatatgggcgtgttcccgctgcattttaacgaacaattgataaatcggaatcgtctcaatcacatggatcgccggctgaatgtaagggctgagttcgtgttttgtaaacgccgctccttctgacaggaatctgaataaaacttcttttatattgatgatgccgactacatgatctttatctccttttacgacgggataccgggtatatttatttgttttgataatgtcccggagcatatgtcccgatccgctgtctaacggcaggctcaccatttcattccggggcaccataatttctttggcagtgcgcttatcaaatgtgaaaatgttatttacgtaatgcagctcactttttttgatcatgccgcttcgatagctttcggcaaggagcacccgcaattcctcttccgtataagccatttcatgttcggaagcaggcttcaagccgaacatggctgtaattaggcgggcggaatgattgagcagccagatgaacggaaacattaacttataaaacaaaatcatcggtctggcagacaaaagtgtaatccgctcggctttttggatagcaaaacttttcggggcgagttcgccgatgacgacattcacatatgtaaccagcagaaaggcgatgatcaatgacagtacttgggcaaccgcttcgtgaactccggtctttaaaaataacggctgaagcattgctttgactgtcggttcacccagccagccgatccccaaagcggtgacggtgatgcccaattggcacgccgataaatattcatcgaggtgtgtaatgacatgcttggctgcttttgctccttttacatcttcctcaatgagctgattaatacgggagcgccttgctttaacgattgaaaactctatggcgacaaaacacgccgttaataatataaatagtacgatggcggatagtttgatgatatacaatgtaacgccttccgcgaaggaaggcttgcacctcccttttttcggaataataccactgtagaaagctgctcaaacatcgaacctggtttagcccgcctcatttacggtaataaaacaagaaagcgatactggaggatgacaagagatgaatgtacattcgggtgcggactggctgtggtaccagctcggtccgcatgaaaaaacggaagcgaaaaaaatgatccatcacaatcactggccgcaatgcgaaaagtggtttgaacatgaaaatcatataaactttctgcgctcagatacaaatgatcagaataatgaagcggttttcggatctttaatctatcatcaaggattagatgatgaaaaaaaccataccgtatttcacttttatattacgagagacttcttttttacgattaattttgatttttcgctgctgcgcggtgtaaaagaaaagcatgccacacagcagattcaaacctgtgaaaatccgattgaaggcttttttgttctgctgggagagctgatgaattcctatctgatcggactggatgaatttgaagtcaagcagcggacgctgaaatggcagattcatgatgacaacagcaaaggaatcttggaaaatgtgcataaactgcgccatgagctgttcatttggaaaggccttacactgggggctaaaaaagtggaaatggctttaaaagaagcatttcttccgaaaaatgacaggcagaaagattacctcagagctcatcataagatggaaagagggattacatatatcaatgagtttgatcaggaactgagcaatctgctgcacgccgaggaagtcattacttcccaaagaggaaatgaaattgtgaaagccttgacgatctttacaactctctttacaccgatgacggcgcttggagctctctgggggatgaactttgataacatgccggagcttcattggaaatatgcgtatatctgttccatcgtgctcattattgtatcaaccctgctgatttatatttatctgcggcagaaaggctggacaggggacattttgagggagcatcaaaaaaaatatttgcggaaagaaaagaaacgctaagaagagcaggcatacgcctgcttttttgatggctgaaaatggccgaatggttccggatttcattcagtaaatcaatgtcagggggcttattttttatttttttgcgttttacacagtgtaaaacgcataatctctcctttgccggcttttgtgtatctgatttacaatacgtgcggaaggagggaagtcttgtgaaaaatattgaaacatacagcaggaacatcataaacgaggcctatacggcaagggcttcagatatacacattgtgccgagagaaaaggatgctttcattcattttcgcatcggccatgctcttgtgaaaaaaagagtcttaaaaaaagaggaatgcgtaaggcttatttctcatttcaagtttttatcggccatggatataggagaaagacgtaagccgcaaaacgggtcattgtctctgccgcttccgacggaaaccgttcatttgagaatgtcaaccttgccgacaatgaatgatgaaagtcttgtcatcaggcttttgcctaagcggcagattccccctctggataaactgtccttatttcggggggcgggcgccgcactattgtcctttctgaagcattcacacggcctgcttctgtttaccggcccgaccggctctggaaaaacgaccactctttactcgcttgtcaactatgcaaaacggcatttcaaccggcggattgtcacgcttgaagaccccgtagaaacaagagatgaggatgtgttgcaagttcaggtgaatgaaaaagccggagtcacatattccgccggtttaaaagcgattttaagacatgatcccgatatgatcatcttaggggaaatcagagatgccgaaacggctgaaatcgcagtccgcgcggccatgacgggacacctcgttctttcaagcctgcatacaagagatgctaagggcgccatatacaggctgctggagtttggggtgaacatgacagaaattgaacaaaccgtcattgccattgccgctcagcgtctggttgatttaacatgtccgttctgcaaagaggaaaactgttccgtgtactgccggatgtacaggcagacccgccgtgcgggcatttatgaactgctctacgggaaaaacctcacccaatgctttcaggaagcaaagggagagcacgccaattttcaatatcagacgctccgcaggctgatcagaaaaggaatcgcgctcggctatgtcacaaccgacaattacgatcggtgggtgtatcatgaagcggattaaacgaacctggccgttgaaggatcaagcggcttttttgaaaaggctcggtgaaatgacggaaaaaggatacagtctgattgaagggctcagactgctgaaactccagctgcataaacgtcagcttgcagagctgacggacggaatccgccggctgagggaaggtgatgcgttttacgaagtgcttgaggcactgtcttttcataaagaagccgtctctatctgctatttcgcagagaaacacggagaattgccgggggcgatgaaacaaagcggcgaattattacagagaaagctcatgcagacgaatcaaatcaaaaaaatgctccggtatccgatgtttttaatttcttccgtctgtgtcatgttttatatcctgcaaagtttaattattccgcagttttctgggatttatcaatcaatgaatatgaatacatccggtgcgactgctttcatctttgcattttttcggcattttcatgaagcctgcgcactggcgctgtccgccgctttctgcttgtttttgtacgtttggttcttatgtaagaaaaaatccccgcaagataaaatgctcattgttgtgaaaatacccctcttgggaaaagcggccgttctttttaacagctactttttctctttacagctcagcagtcttctgaaatccggcctttctatctatgacagcttaacagcttttaaagaacaatcttttctgcctttttatcgtgaagaagcagagatgctcattacacgtctgaaagccggagaaaccatagaatccgctctttccgggcatccgtattatgaaaaagatcttgcggctgcagtcagccacggacaggcaaacggcctgcttcaccgcgaactttatacgtacagccagtttatgatggagcgtcttgaacaaaacgcggcgaagtataccggcattctccagcctgtcatttacggtgttgtggccggtatgattttaattgtctacatgtcaatgctgatgccgatgtaccagatgatgaaccaaatgtaagggagtgcttcggctgaaaaatcaagatggatttactttaattgaaatgctgatcgttttatttatcgtttccattctgcttttaatcaccattcctaacgttacaaaacataatcaaagcattcagcataaaggctgtgaaggactgcagaatatggtgaaagcccaagtgacggcgtacgaaatcgaccatgaaggtaaaatgccggatatgaacgatttacaatcagaggggtatatcaaaaagaatacagcctgcccgaatggtaaacagatcttaattagtggcggagaagttacagttgaacaataacaggcggacagaaaacgggtttacccttcttgaaagcctggttgtgttaagcctggcgtccgtcctgctgacggttttgttcacgacggttccgccggtctgcacccaccttgccgtgcggcaaaaaacagaacagcttcaaaaagatattcagcttgcgcaggaaacggctatcgcagaacataaaagaacaaaaatcacttttcttccaaaagagcataaatacaaactgcagtcaggcggtaggattgtcgagcgttcttttgattcatttcacattacacttgtgactttaccggagagccttgaatttaacgaaaaaggccatccgaattcgggaggaaagattcgattgaagagcgccgggttcacctatgagatcacagtttacttagggagcggaaatgtccatgctaaacggaaataaagggttctctactattgaaacactatcagcaatggccatttggctgttccttatgacgtctatcattccggtctggacgggcatgctgacagacggtctgaaaatagaagatcgccaggaagcgtaccagcttcttcagaaacatatcagcacttatatgatgaccggaaaaaagccgccgtctcccggtgtgaagtggaaggaggatggtgagtattacaaagtgtgtgcggctgaccgcggcgaaaaagaaatgtgcctcagcattctcaaaacagactggctttacgcttcttaatgttttgttctccttggcagtctgtcttttcctatcaggcaccctgggcccgattttacatctgtttttatcaaaccggaccgataacggcggattagacagccgggagcatcaaattgccgttcagcagatcatgaacgaatgtaaacaggctgagactgtgaagccggcggacggcggattggcgttagcatgccggaaaacagggggcgaagaagtgcgttttgaaatttatcataagatgataaggaaaagagtaaacggaaaaggccacgtgccgatcctgcaaaacgcggcatcattaacggctgatgtgaaaaacggcctgctcttattagagatctcaagcgttacaggtaaaaagaatcaggcggtcattccggtttacagctctttaaaaggtgattaaatgtacaaatctgacggttttatctatcccgcggttctgtttgtttctgccgcagttttacttgtcatcagctatacttcatctgatttcatcacccgaaaaacatttgcgaaagaggccggggagtactggatcggagagaatctgctccaaaacggcgcgctgctgtcaagccgccatatgacacagggacaaaaggtccaaactggtacacagcgttttccgtacggaactgtttccttccgcatcaccgggagtaatcgccgggaaacggttcaggttacaattcaggccgaaacagtgtcaggcacgagacgggaggctcaccttttgttcgatcagaagaagaaacagctgattcaatggacggaagtataaaaaagaggcggcgggacaacacttcatagtaaagacagcactatgaggtgagagccgtgaaaacaaatgattatgtaaaatatatgactgagcaattcgttaaatatttcgatacgccgaaacaggaacggagagagcgaaaagaagtgcggaaagaaaagaaagtgccggcttctcagcactggttcggaatattgccgtacagttttaagctgtggatgcagcggaaaaaataaagcgaatcacacgaaaggtcctcctgtatcaggagggccttattggtattcctcaatgacggcaattttatttaccttttggctgtagggattaaaagaaatcgtaacaaacacaccaaattcttttgcgccatcccgcaatgtcaagtggtattgtttgactgcttcgtccgttcttttccggtcccacaccttttgaataaataacgtttgggcgagcggatacctttttttagcttctttttctgctaacttttcccattttgatttatggtgaacagcataataaggcaccgttttcgcctgagctgttcctgaaaccccgaaaacaagaagagaaaggcaaatcagactttgtgtgatcatcattcttcgtcctttcgctgtatatactttccattttgtgctaggcacctcgttattttctcacgttttattagaaaaaattccaaaaaggtgtgtaatttgaagcaaaacgatgtttttgaaagatacgattctcaaaaacgaacaaattgaccgattttgacatttttcaagacgataatccttgattatactttgttcatgaagttctttaaagagaacggttgtcatatttattaacagtttttacagggggtaaggcatgttccgattgttgcgaatggaaaaaaagggcaaggtgagatggcggatgatgctatttttacggctttcgttcattttttgcctgtccgtgacgatatgtgctcagttcacaggtgatacaagttcctccttcaatgatgtgaaaagcttcagtctcccggttcaaacgtgcggagattttcaatatacggatgacgattgccgttatgacgaacgctgggatcagagtgatttacatataacaaatcaaactgatacgtcaggcaccgtgtgtgcgccgcttcaactctatgccgagctggagaataagggaaaagagcggactgtttctgactggaaatgggagctccataaaatcacttctcagcagcagcctttacgaaacggcaatgttgtggataaagggcttattactgataaaaaaagcaaaacgatttttaaaattgagtcaaagcggtctttgcagccgggcatatacgcattcaagatttacaagcctgaagggtatccggcggacgaagaacaatttgagtggtcaaaaccgatgaaactcgtcaaatgccgggaacaggcaaccgtttccgatctgaagaaaacggagaaagagccggctgagccggtaaaagaaagcggggaagaacatgaaaaaaacgctgaaactgatcagtaatattttgtatgccgtcatcttcagcctgattattgtgctgacgttaacggtgatttcgacccgggcttccgggggggagccggccatcttcggctatacgctgaaatccgtgctgtcgggttcaatggacccggaatttaagacgggttcgctcatagcggtaaagaaaatttctgacgtaaatgacttaaaaaaaggggatgtgatcacctttacgcaagatgacggaacagccgtcacacacagaataatcgggatcacaaaaaaggacgggaacctgctgtttgagacaaaaggggaccataatgccgccccggatgccgcccccgttcaagctgaaaaagtggcggcccagtatacgggatatcagcttccgtatgcgggatatgtcatacatttggcaagccagccgatcggaacggcgattctgttaatcgttcccggcgtcatgcttttgatttactcaataacagtcatcgtcagcgccctccgcgatattgagcggaaaacgaaagcgctggaagaacatgcgaaaaagggaaccatctccacatgaatacggttgcaacctggcgacaggatttgataacaaaaaataaaaagtaaggggagtacaaacatgggtatgaaaaagaaattaagcttgggcgttgcctctgccgcactcggtttagcattagtaggaggaggcacatgggccgcatttaatgatgtgaagtcgacggacgctacatttgcgtcaggaacacttgatttatcggctaaagaacaatcagccaatgtcaatttgtcaaacttaaaaccaggtgataaattgacgaaagattttgaattcagaaacaacggttcacttgccattaaagaagtgctgatggctttgaattttactgactttaaaggagcaaagaaaggcaatgaatctgcggaggatttcctcagccagtttgaaattacggttctgacagtcggtaaagaagggggcaacggctatcctaaaaatatcattttaaaggcggccagcctgaaagacttatacttaatgtcaacaaagcaggataaagcagctgccgaagcgatcagcaagcacattgatccgaaattcctgagcgagagcggaaaagtcaatgtggcaaccattaacggcaaaacagctcctgagtacgacggagttccgaaaacgcctgctgattatgaccaggtgagaatggaaatccaatttaaaaatgacaccgcaaaaactgcggacggattaagtgtgcaaaacaagttccaaggcaatgcgatttctcttcaattctcttttgaagccacgcaatggaacggcttgaccattaagaaagatcatacggataaagacggttacgtcaaagaaaatgaaaaggctcacagtgaggataaaaactaatccgaaagtcggacagttaaaagaggagttgtgcacatatggcggcactactcctctttttgcgcttttctccatttttgataatctaaaaattcacgaaattgtttttttgataccccggatgtcatcgcatcgcgaactaatttctcccattcactatctaattgaccatcgtattcggtttcatgtttttcatcaagtaaagtatgaaccgagacgtccagaacagcggagactttttcgagaaattgaatggaggggttcgtctgtaaatttcgttctattgagcttaaataagacttcgctaccccagctttttcagctagttctgatagtgagtagcctttttcttttcggtattgtttaatacgctggccaatcaatgtcatcaccttccttgtgatattatagcacattcagaaaggatttacggtatgacttctggctgcctggatatgttgagaagactttttatgcgaaagcaggtatttgcgtatttcttctaggctgatatttgctttttgggcttctaatatcagctcaacccattccttatctaattgcgaaaattccatttttgcatttttcatgcattttctcctcctaaaatacttgtttatgtatttcagccaatccgcccatgaccttatctttacatgtctggaagtgattcatcgcatgcgaaacgccagaaattttttctatatacttttattataatatagaatttccagaaaaaacgggaaaggtgtcgaatggataacgcttatccagaaaaattactttgcaggaaaaataaaccgccgttttcaatctgaatgtgaattttcggctgatataaggctttcagcgcttgtttttccaaatggtattcctcaggtttttcttctgtctgctcataaaactgatcgagcagcctgaggtcctttttccatctggcgatcgcgctgtcagcccagtctgacggctctttggcggcagcgtcttttaagtaatgctccatccttttaatcccgctttccggcttaatcatcggcgatatggtaaagcaatagtctgatatttgcgaggtcagcggaagcggtgcaagcttctgctgaaacccttctataattgttccagaaacaagatgcaggcctaaagacaaaagtctgtcttttttcatgtcggattggtatgaaatcactacatttaatccaagccagggctgaagcggcactctggctccggctgatacaattttctcatatattcttgtaaatctcccattttgtttaactgcttgaaagatttgaaagaggcgcggggctccaaagtaaataaactcgccgtccatatcctccggagccgtttctttatcagtgatgaacgtaatcttcatcgggttcggttcgccgcccgttttttcacgccaatgccaataaaacgggcggttcataatttgtttgtccatctcgaccgtcaactgaaccgtcataaaacccggcccgtgttctgtaatcgggcagtggttcgcttcaaaaaagcgcagtaaaaattggtgaacctcctgctgtctcatgtcgcgcttcctcctttttaagagcctttttttctggcgggcttttccgtaccgtacgacagaaaagaggtgagattgtccattttgattctcatttcctcctctgtcagcgaatggcataaaatatcatgcaaatggtcttcaaaattgctcactttgatttttgttaaaatgtcatctaattctccgacgacattttcaaataaatgaattttgtcatacagaagttttaagatatgctcttccaccgtatgttttgtcgccatattgtagatatggacatctctttcctgaccgagtctgtgaatccttccgattctttgttcaagccgcatcgggttccacgggaggtcataattgataatatggttgcagaattgcaggttgatcccttcgcctccggcttctgtagcgatcagcacctgcactttgccgcggaagagatccttcatccagtctttttttccgcgtttaaatccgcctctgaacggaacggagcttatgccgttctgctgaaggaaccattgcaggtaaatctgtgtcgccctgtattcagtaaaaataatgactttatcattaatcttttggatcaagtcaacaacttgaatcgcttttgagttttgcgtgacttgattgatgcggtccattaaattagcgatcgtctgttcatcgaatgcgggcgcttgtttgtctttttggtcaagcatttttttgagcgtcatatacacggcttctctgcttgaacagcactctctttgcagcgtcataatggaaaatgcgctggcgggcttttccgtgccgtttttcagtgcggcaatgtcatcgtaaagcgcctgttccgtcggtgaaaaggtgatcggcactgtttccacgtggcgcttcgtccatgtaaggccggtgtcgctccgcgtgttgcggatcatcaccttattgacgagttctttcaaatgctcatgagcgtcaatcccgtccttctgattgaaggtttcttgaaatccgctttcatttcctaaatggccgggctttaacagtgacactaaattgaagatttcttcgatccggttttgaatcggcgtcgccgtcagaagcaggcagtatttcttcacaagacttctcgcaaattcataatttttcgttttgctgtttttgagcttgtgcgcctcgtcaataatgacgagatcatacggaatagaaaggacaatgtctttgtgaggggagcgtttggccgtatcaatagaagaaacgacgatatcgcactgttcccacacatagcttttcttctgttcaacagcgggtattaaaaacttctcctgaagctctttcacccactgggaaacgagtgatgccggcacaagaatcaggatttttttggccagcccgcgaatcatatattcttttaaaatcaggcccgcttccaccgtttttccgagccccacttcatcagccaaaatcgccttgccgttcattttttcaacgactttctgcgcgacctcaagctgatggggaagcggagtgaaatcgggcaggtataaaggagctctcaacccttcaaattcaggaatggcaagggtctgctggacttcagccgacagtttgtacagctcccaatttgaccagggaccgtccgttttcagccgctcagaaaactctcccggccagtttgcatcaaatatgatctctgctgtcatttgtaacaaaaccgcctttcttttaaaaaactgatttatcataatttttgttgccggacgtaaatgagggtggtaggatataagtaatgatttcactaaaagatattgctttagtatgtccataaaattggtaaatatgagcgaatgacagcaaggggagagactcggacgaaagatgggcgtccgggcgccgaaggagcaaactgcggagtgaatctctcaggcaaaagaactcttgctcgacgcaactctggagagtgtctgcacttagaagaagcaggccaccaaaggggacgtctttatgatatgttcataaagtaaactttcaggtgccgggacagagaaaccttcattttcatgaggtgtttctctgtccttttttatatgtttttacaagcgccaatgactgaagggggaagatgatgctgaaacgaacaccgctttatgatgtgtataaagaatacggcggaaaaacgattgattttggaggatgggagctgccggttcaattttcttctattaaagaggagcatgaagccgtccgcacaaaagcgggcctgtttgatgtgtctcatatgggggaagttgaagtatccggtaaagacgccctgtcttttctgcaaaaaatgatgacaaatgacgttgccgatttaaagccgggaaacgcgctttataccgccatgtgctatcctgacggcggtacggtcgatgatttgctgatctatcagaaaagcgagagctgctatctgctcgtgataaacgcgtctaatattgaaaaagacatcgcctggctgacggaacatgaggaaggcgacgtcacgctgacgaatcagtctgaccggatttcactgcttgccgttcaggggccgaatgctcagtcggttcttgcgaagctgactgaatgtgatttgtcctccttaaagccgtttgcatttattgacgaggcggacgttgccggacgccaagtcctgctttcaagaacgggctataccggtgaagacgggtttgagttatattgccgcaatgaagatgcggttcatctatttaaggagatacttgcagcgggagagcatgaaggcctcgttccgtgcggcctcggagcccgtgatacgctgagatttgaagcgaagcttgctttatacggtcaggaattgacgaaagatattacaccgattgaagccggaatcggatttgccgtgaaacacaagaaagattccgattttttcgggaaatctgtattgcgtgaacagaaagaaaaaggagccccgcgaaagctggtcggacttgagatgattgaaaaagggattccgagacacgggtacgccgtgaaaaaagacggtgttccgatcggggaagtcacgacaggtacgcaatctccgactttaaagaaaaatatcggtcttgccttaatcaaaacggaattcagtgaagtcggaacggaagtagaagtggaaatccgtaaaaaaacggtaagagcgaagattgtccgcacaccgttttataaacgtccaaaacagagctgaaaaaggagagtcatatgaagcatcgatatttgcccgcgacagaacaggataaaaaagaaatgctgaaagccatcggcgcagaaacaattgatgaactgtttgccgatattccggaagatgtgaggtttcaaaaagactaccaaattaaaaaagcaaaatctgaaacggagctgacgagagagctgacaaagcttgcggcgaaaaataaggacgctgttacatatgcgtcttttctgggcgcaggagtgtacgatcactaccagccgatcatcgtcgatcatgtgatatcccgatcagagttttacacggcatatacgccttaccagcctgaaatctcacaaggggagctgcaggcgatttttgaatttcaaacaatgatctgtgaattaacgggaatggatatcgcaaactcctctatgtacgacgggggaacggcgcttgcggaagcggcgatgcttgcgtcgggacatacaaaaaagaaaaaaatcgtcatttccgcagccgttcatccggaatcacgggatgttttgaaaacatacgcaaagggccaatatattgaggttgtagaggtgcccgcgaaaaacggcgttacagatcttgaagcattggaacatgccgtttgtgatgagacggccgccgtgatcgttcagtatccgaacttcttcggacaaatcgagccgttaaaggacattgagccgctcgcacataaaggaaacagccagctgattgtttcttcaaacccgctcgcgctcggtattttgacaccgcccggggcatacggagctgatattgtcgtcggagacgcgcagcctttcggcatacctgcggcgttcggcggcccgcactgcggctattttgcagtaacgaaaaaactgatgagaaaggtgccgggccggcttgtcggccaaacggaggatgaaaacgggcgaagaggttttgttctcacccttcaggcgcgcgagcagcatatcagaagagacaaagccacgtctaacatttgttcaaatcaggcgctgaatgctttagcggcttcagtcgcgatgacggcgctcggaaaaaacggcgtcaaagacatggcccgccaaaatatattgaaagctgattacgcgagacgccaagcggaaaaagccggcttgcacgtagcatttgacggcccgatatttaatgaatttgccgtcaggctgaatcttcccgttaaggaagcaaaccggcggctcctgcaagacggcatcatcggcggatatgacttaggtcttgcgtatccggaactggatcagcatatgctgattgccgtcacagagctgagaacgaaagaagagatcgattcgcttattgcgggattgggggatcaacatgaataatcaagatcaggcgcttatttttgaaatgtcccgcgaagggcgtgtcggttacagccttccggagcttgatgtgccggaaacagagcttgaaagccttcttcccggtgactatatccgcgatgaagacgcaaagctgccggaagtatcagagctcgatattatgcggcattataccgctctttccaagaggaaccacggagttgattcaggcttttatccgctcggctcctgtacgatgaaatacaatccgaaattaaatgaaaagattgcccggttcgcaggtttttccgctattcatccgcttcaggacgaggacacggttcagggggcgcttgagcttttatacgatttaagcggacacttggaggagattacgggcatggacgaggtgacgctgcagcctgcggcgggcgctcacggcgaatggaccggcctgatgatgatccgcgcctaccacgaagcgcggggagacttcggacggacgaaggtgattgtccctgattcagcccacggtacgaatccggcatccgccacggtcgccggttttgaaacgattaccgttaagtcaaatgagcacgggctggttgacattgaagatttgaaaagagcggtaaacgaagaaacagcggcgctgatgctgacgaatccgaacaccctcgggttatttgaagaaaacattacggaaatggctgaaatcgtccatcaggccggcggaaagctttattatgacggagcgaatttaaatgccgttttaagtaaagcaagaccgggagatatgggatttgacgtcgttcaccttaatctgcataaaacatttaccgggccgcacggcgggggaggaccgggctcagggccggtcggagtgaaaaaagaattcattccgtatctgccgaaacccgttctcacgaaaaaagagggccgtttgacttttgattatgaccggccgcagtcgatcgggcgcgtaaaaccttattacggcaacttcggcattaatgtcagagcctacacgtatatccgttccatggggcctgacggcttaaaagctgtgaccgaaaacgcggttttaaatgcaaattatatgatgagaagactcgcgccttattatgatctcccgtttgaccgtcattgcaagcatgaatttgtgttatcgggaagaaagcagaaaaagctcggcgtaagaacgcttgatattgccaaacggcttttggatttcggctatcatccgccgactgtgtattttcctctcaatgttgaagaaagcatcatgatcgaaccgacggaaacggaatcgaaggaaacgcttgatgcgtttatagatgccatgattcaaattgcgcgggaagcggaggaatcgcctgaaatcgttcaggaggcgccgcatacaacagttgtcaaaagaatggatgaaaccaaggcggcaagaaagccggttttaaaatacgaacgtacacctgacgtcagccgctgacacggtataaaaaaagagcttccgtataaaacggacagctcttttttcatgattagttttttgctttaatttttccgccccattttttaaatccgcctttcaggttgtaaatatctttgcagccgtgtttgcggagcgtctgtgccgcgcgtccgctgcggacattgttttggcagtacagataaacgggtttatcaggacggatttcacttttgcgctgtttcagctgtgacagcggaatgttgcgcgcgccgagaatatggccgccttcaaattcattcggttcacggacgtcaatcagctgcgcttttctgtagcccgcgcggaattcctcttccgtaagtgttttcattaaacgctgctggtaaaaatacgaaacgatcatataaacgataaacgccgcaacaataattaaagcaatcatattagacaatgcaattctactcctttagcttataaaatcaaaaccctgcttcctgaaaacaaggcttaccggacgttttgggacaaatactattatagtaaagcatgaagcgattgtcatccttaatgaaacgaaatatttttcattttcaaggcagtttgttaaactgattttattaaaacgataaagaagggttcagtgtatggaaaaagaaacatggcggtttattgactcagggaatgaaagcccggcatttaacatggcgctggatgaagcgcttttatattggcacagccaaaaaaaaattcctccggtgatccgtttttacggctggaatccggcaactttgtctgtcgggtattttcaaaatattaagaaggaaattaactttgacgcagtacataaacacggcctcgggtttgtcagaagaccgacaggcggacggggtgttctgcatgataaagaattgacatacagcgtaatcgtttcagaggatcacccggaaatgccggccacggtgacagaggcgtaccgggtgatttcagaaggtattctgcagggattcagaaaccttggacttgatgcctgctttgcgattccgcgaacagagaaagaaaaagaaagcttgaaaaatccgcgctcgtccgtctgctttgatgccccttcgtggtatgagctggtcgtcgaaggacggaaagttgccggaagcgcacagacacgccaaaaaggtgtcattcttcagcacggttccatcctgcttgacattgatgaggataagctgtttgatctgtttttatatccgagcgacagagtccgtgagcgcatgcagcggaatttcaaaaacaaagcggtagccatcaacgccttagcgccgaaacgggtaacgatggatgaggccagaatcgcttttaaagccggttttgaggaagggctgaacattcatcttgagccttacacactcacgtctgaagagcttgcatttgtcaatgagctggctgagacgaaatacgcgtctgatgaatggaattataagcgctgataaggcttgacagaccggaagcatccttgttttttcatgaccgttagtgtaaacttgtaatggtttataaagttaaggtgctttttgggagggttacttatgacaacaccaagtatggaagattatattgaacagatttatatgctgatagaagaaaaaggatatgcacgggtttctgatatcgcggaagctttggcagtccacccctcctctgtaacgaaaatggttcaaaaactagataaagacgagtatttgatttatgaaaaatatcgcgggctcgtattgacgtcaaaaggcaaaaagatcggcaaacggctcgtatacagacacgaattgcttgagcagtttttaagaatcattggtgttgatgaagagaagatttacaatgatgttgaaggaatcgaacatcatctgagctggaacagcattgaccgcatcggcgacctcgttcagtattttgaagatgacgaaagccggaaaaaagaattgaaatccgtacagaaaaaaaccgaaaatcccggtgaataaagggcagcccgaaatggggcgccctttttttaatgtcttcattctttggtctatttcgcccagccgtttcttaaaataataatacaccttgagatggaagggagagggcgcgctatgcagattgacggcgtattttcgggcggggggataaaaggggtggcgcttgccggcgcttatgaagcgctggaagaaaagggctttcgctttgaaaggctcgccggaacaagcgccggcgcgattattgccgcatttatcgctgcgggctatacgagcagagaggttcattccatcatagatgaggtggacggaaggcaattgcttgatcagagatactcatttctcccgctgaaaatcctgcagtgggtgtcgatatattggcgcctcggactatacagaggcgatatgctggaaaagtggattgcggataaattaaaagcgaagggcatcatcgcgttcggcgatttgaaaaaaggctcgctccgtctcatcgcttcagatctgacgaacggaacgatgatcgtgcttcctgacgatcttccccgctacggattaaatccggagatgttcccggttgccagagccgtcagaatgagctgcagcattccttatttttttgaaccgataaaactgaagaccgaaaaaggcacctcaacggtcgttgacggcggcgtgttaagcaatttcccgatttggctgtattcaaaagaacgcaaacggccggtcatcggaatttcgctttcgcccaacgaaaaagagcgcccgaaaaaatcaatccgcaacgcttttgagctgttcggggctttgtttgaaacgatgaaagacgctcatgatgccaggcatatcgcgacaaagtacgaacagaatattatttttattccggtggaacatgtgatggcgacggagtttcatctcacaccgcaaaaaaaactagctctcattgagctaggaaaaagcagaacagagcaatttttgaagcaatggagctattaaaaaagcgctctgtttttctttttattctttttgccttctatgacggtaagctgggtctggctttttttcttaagaatcatcggcttcggtctgctgctgctcggcacgctccgcaaatggctgacccggcctctgtgtccggcgcggtgcttcgctttttgctccttcattcggagccgcgattgtctggccgcttttttgaaagcggttccgtcacggccggtgcgtcggttcaggaccgtcctcacgataaaataaataataatgcctgcgataataacggtgattgctcttgaaatcatctgcccggggttggttaccgccgcataaatgaaaccgaatgcgccaagcgctatcaatacagcaaaaaaaggttgtacacgatgattcataactgcccacctccaaaataataacggtaacggttcagattacgttgtgagacggcttttcgctctgttctgaaatgtcttccagtctgagaagctcgttaaagctttctatggcaacctcgacctggtcatccgccggttcctttgtcgttaaaagctgcagccacaggccgggataaccgagcactttcaaaacggggatattccgtactctgttcgtcagctggagcacttcaaaggagatgccgagaacgaccggtataagcgcaatcctgtctaaaatccgcacccaaagcggatctgtcggaacgagtaaatagacgaacatgccgacaatgatcgtaaataaaataaagcttgaaccgcaacggtaatgaagccgtgactgtttctgaacattttctattgtaattggcaaattctgttcataacagtttatgaccttatgttcggctccatgatattgaaacactcttttaattaacggcgtcattgataaaaaataaatgtagccgagaagcagaatcagcttaaacagactttcgattccgatctgcgcggcgtctgaggaaaatacgggccttacaagctccgctaagaagaccgggacgagcgtaaaaacgaatttgctgaacaaaaacgacaaaacgccgatcaccgccaggctgaaaaacatcgataagccggaacccttcttatcttcctgctccagcttggcgtcatcctgaggatcaagcccgtaacgttcgctggaaaagtttaaatgctttgtgccgttggcgctcgcctcaatgatggcgacgattccccgcaaaaaaggaatcttttttaaagccgaaagcttggcgttcggcactctcggaagcttgaaaaaatcaatgcttccgtcattcctgcggatggcggtaacataattttttctgccgccgaacattaccccttcaacgacagcctgcccgccgtatgcagggggcgttttttgtttggacattgtttatcaacctgcctgttttcttaggatttactaaccatttcctttcactctattgtacaggaaaccgcggtaaacctctagttagacagccggaaaatcaatgctttttctacatgcagtataccccgtttctttagattttactcattgaatgaaaatatggcgcagctttttatgacttttcaatttttgggcagtctatgactggaggtgccatgatgacaagcgaaaaacattcagaacaggaagaaaaaaagaagcgggatgatgatcagcagcctgtttcatttaccggcagaatttgcggtatcggatttgccggcggtgtattttggagtttgatcggctatctcgggtatgtctttcatttttcagagatcagccccaacatgattcttcagccgtttatgatcggagaatggaaaaaacaatggctgggcacgatggtcagcatcgttgtcatcggattcatttcaattgccggggcgtttatttatttcgtctgcctgaagcgttttaaaaccatgtggccggggatggtgtacggcgtcattttatggtgtgcggtttttttcttattcaatccgattttcgaagatgtgaaatccgtcactgaattgaaatcagacacaatcgtgacgacgctttgcctttacattctgtacggtttgtttgtcggctactcaatttccttcaactacaatgaacttacgtcagacaagcttgcaagggcgctcggcaacaagtgaataagtgtataatccctgtccggtatggtaaaatgttcacgagaagtgaacattttttatgctgaaaaccgggcggggatgctcccgcgttgtcaggcggcagtcaagaatcggcgaggaggagaaagggaatgaaacttgagaaattgcgaaatcttttcggtcagctggatatagacggaatgttggtgacaagctccgccaatctgcagtatatgacgggatttacgggttcgtcaggccttgcggtcatatcgaaagaacgtgcggcatttatcacggatttccgttacaccgagcaggcgaagacgcaagtgaagggttttgacattatcgagcacggcggaagcttaatccaaacggctgcggatacgattcttgagtacggcattaaaaaactcggcttcgagcaaaacagcatgacgtacggaacatatgcatcctaccaagcggtgctgcaggaagcggagatggttcccgtcgcggattccgttgaaaagttgcgcttgattaagtcaagtgaagagattaagatattagaggaagctgcgaagattgcggatgatgcgtttgaacatattctgacgtttatcaaaccgggcatctcagagatttcagttgcaaacgagcttgaattttatatgagacgtcaaggagcagacggctcttcctttgatatgatcgtcgcctcgggagtcagatccagccttccccacggagtggcaagcggcaaattgattgaaaagggagacttggtcacgctcgatttcggcgcttattataaaggctattgttctgatatcacacgcaccgtcgcggtcggagagccaagtgataaactgaaagagatttatcaggtcgtatacgatgcccaagcgcttggtgtcctgcatattaaacccggcatgacgggaaaagaagcggatgccctgacgagggatcatatcaccgcaaaaggctacggacagtatttcggccattcgacaggacacgggttcggaatggaagtccatgaatcaccggggctgtctttcaggtcatcggccgttcttgagccgggcatggcggtaacggttgagccgggcatatacataccggaagtcgggggcgcaagaatcgaagatgatatcatcatcactgaggacggcaaccggacaattacgcattcccctaaagaattaattattttgtgatcggaatataggaggacatcaaacatgatttcagttaacgattttcgtacaggactaacgattgaagtagacggcggcatttggcgcgtcgttgactttcagcacgtaaaaccgggaaaaggagcggcatttgtccgttctaaattgcgtaacctgcgcacgggcgctattcaggagaaaacattccgtgcaggtgaaaaagtcgcgaaagctcaaatcgaaacaaaaacgatgcagtatctttatgccaacggcgatcagcacgtgttcatggatacaagctcatatgaacagcttgaattgaacgaaaaccaaatcgaagaagaattgaaataccttctggaaaatatgtctgtgcatatcatgatgtatcagtctgaaacgctcggtattgaactgccgaacacagttgaactgaaagttgttgaaacagagccgggaattaaaggcgacacggcgtcaggcggtacgaaacctgccaaaacggaaacaggccttgtcgtaaacgtaccgttcttcgtgaacgaaggcgatacgctggttgtaaatacatcagacggttcttacgtgtcaagagcgtagttaaagaaattcggagtctgctccttttacggggcaggctttttttgcattctgcctcagaatctttcttctatatgaaaatagtgagactacttccgtgagctagagcatatagtgtaacaaaatgcttgaagttgggggattgcaatgaaatttttgttcggttcaatcaattctactgttttaacgatggccggtttacgagttttgtcctcgctcattgaattatctgccgctattatcatgcttttgacaaacgacatcagaaaagcggttgtggtgaatagtattttggcaatcgtcggccctctgatctttatcatcacaatgacgatcggcatttatcagattgccggacagctctcatatgcaaaattaatattgatttttgcgggggtggtgctgattttggccggtgtgcataaatagagggccggggtgtcataaagtctgtcccggatcatacattttaaagaagccaatcggtaaaaaggaggggactctattgaatgaaattacagaggttctccctgaattattgagagatgccatctccgccgtgcccgaagaagcaaggcgggatacagaagaaatcagaatccgggtcgacaggccggttgaactgatccaaaaaggacaacctttgtatttgtcatatgtgtgtacggccggcgacgcacagctgatcctcagccggctcagcaactacagtatgtacacgctggaagaagagctgaaaaaaggatacatcacaatcagaggaggccaccgtgtggggctggccggaagagtcatcgtcgaaaacggagccgtcaaaggactccgggatattacttcttttaatatccgaatcgcccgggagaagctggggatcgcagaaccgctcattcctttcttatggaaagaaaactggctgaacacgctgatcatcggtcctccgcaaacggggaaaacgaccttgcttcgtgatttggcccggctttccagcaccggatcaaaacgcattccggcaaaaaagacaggtatcgtagatgaacggtcggaaattgccggctgcctgcggggcattccccagcacagtttcggccgcagagtcgatgtccttgatgcctgtccgaaggcggaagggctgatgatgatgatccgctctatgagtcctgaggtcataattgtggatgaaatcgggagaatggaagactcacaagcgctgctggaggcgctccatgcgggcgtatccgttatcgtctctgcgcacggatggaatatgaaagacttggtcaagaggccgtcgctgaaaatgctttgggaggaaaacgtgtttgaccggtatgttgaactgtcaaggcaccgcggtccgggaacgatcagcaggatgtacggaaaggacggggaacctgttccgcatgctgaaagcgtgatgacatgctgaagcttttgggtgccgtgttcattctgacagcgacgacatggacgggatttgagatcgccaaaatgtatattgaaaggccgagacagatccgtcagctgcgcgcggcgctgcaatcgcttgaagcggaaatcatgttcgggcatacgccgctgcacatagcttcgggacaaatcgccgcacagctttccaagcctgtatcgtcattgtttcaagctttcagcaggaggcttgagcagggaagcgattccgccaaaacggcctgggaacagagcttgaaacataactggccctccatggcgatgaaaaaaagcgaatacgatgtgctgaagcaattcggagagacgctcgggctccatgaccgtgtttctcagcagaaacatatcaagcttgcgcttacacatttggaagcggcggaagcggatgccggacgggcgcaggcgaaaaatgaaaaaatggtgaaaagcttaggatttttagccggactgttactcattcttctattgatgtaaacatgaggggagcaaacataaaatgggagtcgacgtaaatgtcatttttcaaatcgccggagtcggtatcgtggttgcgtttctgcacaccatacttgaccaaatgggaaaaaaagaatacgcccaatgggtgacgctgcttggctttatctatattttatttatggtggcgacgattgtcgatgacctgttcaaaaagatcaaagctgtgtttctattccaaggataggggggcttacagattgagattgttcaaattgtaggtttaggcctgatcgccacatttctctccctgatcgtaaaagaacagaaaccgactttcgcgtttatgattgtcgtcttcagcggctgcgtgatctttctctatctcatcgatcagatttacgacattatcagaatgatagaaaaaatagccgtcaatgcaaatgtcaatatggtctatgtggaaaccattttaaaaattatcggcatcgcctacatcgctgaattcggtgcgcagctgacaaaggatgcgggccagggagcgattgcttcgaaaatagagctggccggaaaaattttgatactggtaatggccgtgccgatactcaccgtcattattgaaacgattctcggacttattccttcttgatcatcaataaaatggaaaggggggcacaaaaaatgaagcgctttcggtgggcgggggcttttttgttcatcctcttattttttcagactgaatgtgtacaagctgccggaacagacggtgcgtcgcaggaaaccgcagttcaccaagaatccgctgatgaagtggcgaaaaagcaggccgaagcgctgaaaacagaaggcatcggaaagttttgggacgacatcatgacagaatacggcggtcttctgcctgaaagccaaaagggaagcatcatcgactttattaacggtgaaaaaacgttctcgccggaggcatggctgaaggctttattttcatacttgtttcatgaagtgctcgcaaacggaaagcttctgggaactttgattcttctcaccatcttttgtgtcattctgcagcttttgcaaaatgcgtttcagcagagcactgtcagcaaagtggcttatgcaatcgtctacatggtgctgattattctcgctttaaacagctttcatgttgccgtcaattatgccagtgaagcgatccagacgatgacaagtttcattctcgcgctcatcccgcttttactcgcgcttttggcgtcttccgggggagccgtctccgcagctttttttcaccccgttattttatttctgatgaatacgagcggccttctcattcaaaacattgtcatgccgcttattttcctgtcagcgattttaagcatcgtcagcacgatgacggatcaatataaagtcacgcagcttgccaatctgctcagaaatatcgcgatcggcgcgcttgctgtatttctcaccgtgtttctcggcgtcatctccgtacagggggcttcggctgccgtgacggacgggattacgctcaggactgcaaaatttatcacaggcaattttattcccgtgctcggccggatgtttacggatgcgacggatacggtcatcagcgcatcgctcctattaaaaaacaccgtgggaatcctaggagtcggaattttgatctgcatctccgcgtttccggcgatcaaagtgctctcgctcgcttttatttataagctcgcggccgctattctgcagccgctcggaggcgggcccgtcattacgtgcctcggcgtcatcagcagaagcgtgctgtatattttcgcggcgctcgccatcgtctctctcatgtttttcctcagtattacagtcattattacagcaggcaacctcaccatgatgatgaaataaaggaggcccattggatatgagctttttaacagaatggctgacaagcattattttgtttatcttattcgccatcgtcatcgacatgctgctgcccagctccagtatgcaaaaatacgccaagatggttgtcagcctgctgttaatcattgtcatgctcaacccgatcttcaaacttttcaaaacagacccggaaatcatcttcgattatttgacaaaacaagagcaatctcaatccgctgatataaaaaatcaaatcaaatcagaaaaaaaagaaatacaagcatcaaaccgcgcatatgttttagaagaaatggctgtccaactaaaaaagaaagcggaggagatgttcagtcatgacgaatacaaaatagacgacatccgccttacagcggaagaacaggttcgttcagaagaagatgtaaaaacgatcagcgtgtatatggccccatcttctgaaaaaaccgtgcaaaccgtcgcaccgatcgacatccgcacagaccgcaaatacgaaccggaaggcgcagccgacaaaaaagaggccgcagacatcaaagaaaaacttgcggatatatgggaaatcggcagtgagaaaattacggtttatatggaaggcggggagaaaaacggccatgaataaaaacggactatggaccatactcaaaaaacagctgatgatcggacaggcgaaagacggagaaaaaccaaaactgacaaaatatcattactttctgttcgtgtttgtgctcggagtatcttttatgctggtgagccagctgttctcttcaccggagaaaaccgggaaggaccaagcggcgcagaccgtcatgtccggccgaacggaagacaaaagcgggcaaaaaagcgcacccgtttttaaggcatcgaaagacagcagcgccaaaaacacgatcgatgattatgaaagagactatgaaaaccagctgaaagaaatccttgaaacgattatcggcgtggaggatgtatcaattgtcgtgaacgtagacgcaacatctttgaaagtgtttgagaaaaataaaacgaaaaaagacaccaccaccgaagaaaccgataaagaaggcggcaaaagaagcgtaaccgatcaaacctctgaagaacaaattgtcatgattcgaaacggggatcaggaaaccccggtcgtcgtccagacgaaaaagcccgatatccgcggtgtactcgttgtcgctcagggagtggacaacgttcaaataaaaaaaaccatcattgatgccgtcacaagggtgcttgatgttccgagctaccgtgtagcggttgcccctaaaaaaatcaaggaggattcataaatcatgctgaaaaaacaaacggtttggcttttaacaatgctcagtctcgtcgtggtattaagtgtttattatattatgtcgccggaaagcaaaaatgccgtgcagatgaaaagcgaaaaaagcagcggagaagtggcaactgaaaaaacgccggctcctgaaacgaaagataagaacggaagcggcacggataaagaagacggaacaaaaggaacgaaagattctaaaggcgcaaaagaggataaagaaacatcagccgaagcatcggacaaagacggatcggtcgctacagaaacagctgatgaaaacttatttaccgcataccgcatggaacttgaagacgcaagaagcaaagaaagggaacagttaaacagcattgtttcaagcgatgatgcgaccgcaaaggaaaaaagcgaagcctacgataaaatgacggcgctgagcaatgctgaagggacggaaaaacagctggaaacgctgattaaaacacaaggctacaaagatgcgctcgtggatgctgaaggagacaaaatcaacattacggtcatgtctgacaaacattcaaacgcaaaagcttccgctatcattgacctggtggaaaaagaaatcaagacgatgaaagacgtcgccgtcacgtttgaaccgacaaaataagagatctccaccgcccgcacccgctgcgggcttttctgatgtcattttagatcagtgttgaatttacacaagcgctcctgtaagataaacatagtatgtacttttagtagcaacccataaatttctattttttatacataggagtggaaactgatgttaaaaatcaacgaaattcatgaactgataaaaagaatcgatgaatcttccatcgacgaattcgtttacgaaatcgaaggcgtaagcctcaaactgaaaaaaaatgaagcgccggcagtgaatgtaacgggacaagctcaagccgttcccgccgcttacgcacctgctccgcaggctgcaaaaccggaagcgcatgaagccgctcctgttcaggaagcgccgaaacaagacgaaaacctgcacaaaattacgtctccgatggtcggaacgttttatgcttcttcatcgccggaagccggcccttacgtaaaccaaggttcaaaagtgagcgaaaatacagttgtttgtatcgtagaagcaatgaaactctttaacgagattgaagccgaagtaaaaggagaaatcgttgaagtgttagttgaaaacggccagctggtcgaatacggacaacctctatttcttgtaaaagctgagtaaggagacctgctattatgattaaaaagctattgatcgccaaccgaggagaaatcgccgtcagaatcatccgggcctgcaaagagctgggcattgaaactgtagccgtttattctgaggcagataaagacgccctgcatgtccaaatggccgatgaggctttttgtatcgggccgaaaacatcaaaagaaagctatttaaatgtaacgaacatcgtcagcgtcgcaaagctgaccggcacggatgcgattcatccgggatacgggtttttagctgaaaacgccgactttgccgagctgtgcgaggaattgaatgtaacgtttgtcggccctacggctgacgccatttcaaaaatgggaacaaaagatatcgcgcgcgacacgatgcagctggcgggtgtgccgattgtgcccggttcaaaaggaatcataaaaaataccgaagaagcggtttcgcttgcaggtgaaattgggtatcctgtgattataaaagccactgcgggcggaggcggaaaaggcatccgggtcgcacgcacagaagaagaactgatcaaaggcattgaaattacccagcaggaagccgctacggcattcggaaatccgggtgtgtacatcgagaagtacatagaagatttccgccatgttgaaattcaggtgcttgcggataattacggaaacacgatccatctcggagagcgtgactgttctatccaaagacgtctgcaaaaacttcttgaagagtcaccgtcacctgcgcttgattctgaaatcagggagcagatgggcgaagctgcggtaaaagcagcgaaggccgtcggttacacgggagccggcacagtagaattcatttatgactacagagaacagcgctactacttcatggaaatgaacacgcgtattcaagtagagcaccctgtcacagaaatggtgacgggaacggatctgatcaaagaacagatcaaagtagcatccggacaggagctttcgctcagacaggaagacgttgaatttaacggctgggcgattgaatgccgcatcaatgctgaaaatcctgcgaaaaacttcatgccttcacccggtaaaattaacatgtacctgccgccgggcggactcggcgtacgcgtggattcagccgcatatcccggctattcgatcccgccgtactatgacagtatgattgctaaagtcatcacatacggaacaacgcgtgatgaggcagtcgcacggatgaaacgcgcgctgagcgaattcgtgattgaaggtattgaaacgacgattccgttccatctgaaactgcttgaacacgaaacatttgtcagcggagagtttaatacaaagtttttagaaacatatgatgtaatgggctcataatttttgcgggaggtgaattgaatggaagacaacagtgtgcttaaaatggatcatgacgaggctcatttaggcaaggttgaaattgctcctgaggtcattgaagtcattgccggcatcgccgcttccgaagttgaaggagttgctgaaatgcgcggcaatttcgccaccggcgtcgtagaacgcttcggcaaaatcaatcacggtaaaggcgtaaaggtcgatttagccgatgacgggattaccatcgacgtctattgcgtcgttcaattcgggatctcgatcccgaaagtggcggcaagcgttcaggagaatatccgccaaaccttattaaacatgacgtctctgaccattaatgaaatcaatattcatatcgtcggcattcaatttgacacgaaagcccaagaagtcgaaatcgacgaagaaatgtaatgagcgtataaaaaccaaggggatgggcagccctttggttttttatacgtttcccgtcatttcaggcatgaagaaagccggcttacaaacggcagccgagtttcttcatgctgtgaaatccgaatgaaattaatacggtttgtgaaaatattcggcattagggtgaaaaaacctaaatttcgacatgcgattgagaaaaaaatatgttatgatctctttaagcttaacgacaagcggataaagcggatctgaaggagaaagaaaatgaaaagaagaacagctagagaaaaagctttgcaggcactttttcagattgatgtcagcgatattgcaccgaacgaggccattgagcacgcgcttgatggtgaaaaaacagatgccttctttgaacagctggtgtacggagtgatcgaacatcaggttcagcttgatgaaatgatttccggccatctcgtcaattggaagcttgaccggattgcaaacgtagaccgcgcgatcctgcgtctggcggtgtatgaaatggtttatactgacgacattcctgctaacgtgtcattaaacgaagcaatcgagctggcaaaacggttcggcgacgataaagctgcaaaattcgtaaacggggttctttctaacattaaaactgatatcgaatcataggaggaaagaaaatgactgcaacaatcatcgacggaaaagaaacggctaaagaaaaacgcgaacaattggcaaaagaagtagaagagctgaaagcacaaggcgtagtgcccggtttggcggtcattttaatcggagacgatcccgcttctgtttcatatgtgacaggcaagaaaaaagccgctgaaacaatgggaatgaaatttaagcttgaccgctttgactcaagcttaaccgaggcggagcttttaacagtgattgatcagtataatcaaaatccggaattccacggcattctcgtccagctgccgctcccggatcatatttctgaaaaagccgtaatcgagcggatctctcccgataaggatgttgacggtttccaccctctcaacgtcgggaaaatgctgcttggcgaagatacatttcttccatgcacgccgcacggaattgtcgagttattgaaaaagacgaacgtaaatctttccggcaaagaagttgttgtagtcggacgaagcaatattgtcggtaaaccggtcggccagctgctgctgaacgaaaacgcgaccgtcacatattgccattcccgcacgaaaaatatgtctgagcatacgaaaaaagcagatattcttgtggtagcggtcggtaaagcgaatttcatcaaagccgatcaaatcaaagagggcgccattgtcattgatgtcggcgtcaaccgtctcgaaagcggaaaactctgcggagacgttcagtttgatgaagcgaaagaaaaagcatctttcattacgccggtgccgggcggagtaggtccgatgaccatcacaatgcttgcgcataatactgttaaatctgccagacgtacgttatcatagataaccggagacagtcacaaaaagtgtgacaatgagcacgatacccgcttcttaaggctcctttcagccagagcgggttttcttagtttagggcaaaaagcctttatgaaaggagtgcaggatgtgagtgaagcggcatatgtcacggtttccgcgctgaccaaatacattaaacgaaaattcgatgtggaccctcatcttgaagacatttggattaagggtgagctctccaatgttaaaattcatacgagaggccacatctattttacattaaaagatgagcatgcccgcatgcaggccgtcatgtttcaaagacaaagttcgaggcttgcgtttaagcccgaggacggaatgaaggtcatcgtaagaggcggcatttccgtctatgaaccgagcggaagctatcagctgtacgcgaaagaaatgcagccggacggtgtgggggcgctctacttagcatatgaagaattaaagaaaaaacttgccggcgaagggttgtttgatgaccggcataagcaggccatccccgcttttccggccacgatcggggtcgtcacgtcaccgacgggagcagccgtcagagacgtcattaccacactcaaaagaagatacccccttgtgaaagtcattgtgcttcccgcgctcgttcaaggtgaaaatgccagcagatcgattgtgaagcgcattgaagaagccaatgcacaaaaaatgtgtgacgtcctgatcgtcggaaggggagggggctcgatcgaagaattgtgggcatttaacgaagaaatcgtggcccgggcgatttttgcttccgtcattccgattatatcagccgtcggacatgaaacggattttacaatcagtgatttcgtcgcggatatccgggcggcaacgccgacaggagcggcagaaatcgccgtcccgcacacgacggacttaatggaacggacaaaaacggcggaagtccggctgacaagagcgatgcagcagcatatcagcaagaaaaaagaacgggttcaatcgctccagtcatcctacgcgttccgttttccgaaacgattgtatacccaaaaggaacagcagtttgatcttttgtatcagcagttccaatcacagctcacagggcttacggacaggaaacaaaggcagctggagcggaatacgtacagattaacggcgctccaccctgaaacccagctgaaacaggcgaaaaaacggtacgaggagcgctcaaatcagctcgcccgaagcatgaatgtccagctgaagcagcttcattcgcagtttcagacggttcttggtaaactgaatgcattaagtccccttcaggtgatggagagaggatacagtctggcctataaagataaagagctgatcaaaagcgttgatcaagtcgaacaaaatgatacgcttgaagtaaagatgacagacggcgttctgacgtgtgaagtattgcaaaagagaggcgaacgaaaatgacagaaaccaaaaaaagtgaagagctgacatttgaagaggcgatgaaaggccttgaaggtattgtggcaaagcttgaagaaggagacgtgccgcttgagcaggcgattaattattttcaggaagggatggccctttcaaaaatgtgccatgaaaagcttcagcatgtcgaaaagcaaatggactttattttaaaagataacggcgaacttgcacctttcagcgttcaggaggaagacgaaggtgacaaataaactggacgcatttttagcatcgcgcaaaaaactgattgaacagcagctttctttgtatacggaacggcttgcgatgcctgaaatcctcaaaaaatctatgctgtattctttggaagcgggcggaaagaggctgcgccccctcgtcgtcttagccgttctgaatgcttacggaaaagatgaaaaagacgggattccggtcggatgcgctgtcgaaatgattcatacgtattccttaatccatgatgatcttccttgcatggacgatgatgatctgcgccggggaaagcccacaaaccataaagtcttcggagaagcggcagccgtattggccggagacgggcttctgacagaaagctttaaattgatcacatcccacgtgtctgaggcggtttcagcagaaaaacggctccgtctcgtcgatgagctgatcagcgcggcaggaacggaaggaatggtcggcgggcaggctgccgacatggaagcggaacaaaagcggataacgattgaggagctggaatccatccacgagcggaaaacggccaagctcctcggtttttctgtgacggcgggcgccattttggcagatgcgccggaggatgaagtcgaaaagctgcgtctgttcagcagccatatcggcatcggatttcaaatcagagatgacatccttgatattgaagggcatgaggagaagatcggcaaaccggtcggctcagacacgtcgaatgaaaagtcaacgtatccgtcgcttttaacgcttgaaggcgcgaaagagaagctggcgtatcatatcagcgaggcgaaacggatcatcagcggcctttctcttcagaaagaactgctgcatgacctctgtgatttaatcgcggcgagagatcattaaaaacggtcctgatttgaaggggctgccgctcctatggtaaaatgtaagcagtttcgatgaaaatacaaagggagtctttttcttttttcaaaaagacactgtttaatttgcagaaattcatgctgaaagtgagttgatccgctttggatcttttatcaatacaggacccgtcatttcttaaaaagatgtcaattgaacagctggaagagctgagtgaggaaatccgcaatttcctcatcacatcgctgtctgcctctggcggccatatcgggccgaacctcggggttgtcgagctgacaattgcgcttcacaaagaatttgacagtccgaaagataaatttttatgggatgtcggacatcagtcctatgttcataaactgttaaccgggcgcggcaaggagtttgaaaccttgcgccaatataaagggctttgcggtttcccgaagcgcagcgaaagcgaacatgacgtatgggaaacaggccacagctcaacatcgctctcaggcgcgatgggaatggcagccgcccgtgatattaaaggatcgaaagaatatatcatcccgattatcggagacggcgctttaaccggaggaatggcgctcgaagcgctgaaccatatcggtgatgagaaaaaagatatgatcgtcatcctgaatgataatgagatgagcattgcgccgaatgtcggggcgattcattctatgctgggacggcttcgcacggccggcaaatatcaatgggtaaaagacgagcttgaatatttatttaagcgcatcccggccgtcggcggaaaattggccgccacagcggaacggataaaagacagcttaaaatatatgcttgtgtcaggcatgttttttgaagagctgggctttacgtatttaggccctgttgacggtcattcctaccatgaactgtttgaaaacctgcaatacgccaaaaaaacgaaaggtcctgtccttttgcatgtcattacgaaaaagggcaaaggctataaaccggctgagaccgacacaatcggcacatggcacggaacgggtccttataaaatcaatacgggtgatttcgtcaagccgaaagccgcggcgccttcatggagcggacttgtcagcggcaccgtgcaggagctggcgcgcgaggatgacagaattgtcgcgattacaccggctatgccggtcggctctaagcttgaaggatttgcgaaagaatttcctgagcgcatgtttgacgtcggaatcgcagaacagcatgcggcgacaatggccgcgggaatggcgcttcagggtatgaagccgtttcttgcgatttattcgacctttttgcagcgggcgtacgatcaggtcgtccatgatatctgccgtcaaaacgcgaatgtatttatcggcattgaccgcgccggtttggtcggcgctgacggggagacgcatcaaggcgtctttgacatcgcctttttgcggcatataccgaacctcgttttaatgatgccgaaggatgaaaatgaaggccgccatatggtcaatacagcccttaattatgaggacggtccgattgcgatgcgcttcccgcgcggaaacgggctcggcgtaaagatggataaagagctgaaaaccatcccgatcggaacatgggaagtgctccgtcccggaaaagacgcggtcattttaacattcggtacgaccattgaaatggcgctggaagcggctgaagaactgcaaaaagaaggcctgtccgtgcgtgtcgtgaatgcgaggttcataaaaccgattgataaacaaatgatgaaggccgttcttaatgaaggtctgccgattttaacgatagaagaagccgtgcttgaaggcggattcggcagcacgattcttgaatacgctcatgacctcggcatgtatcatacaccgattgacagaatgggcatcccagaccggtttattgaacacggcagcgtaaccgccctgcttgaagaaatcggtctcacgaaggctgaggttatgaatcggataaaactgctgatgccgccgaagacacataaaggaattggatcatgacagcaaaaaaagaacgattagatgtacttcttgtagaaaaaggccttgcggaaacgcgggaaaaagcgaaacgcgccattatggcgggcatcgtatactcaaatgaaaaccgattggacaaaccgggtgaaaaaatcgcccgggatcttccgttaacggtaaaaggaaaccctcttaaatacgtcagcagaggcggattaaaacttgaaaaagccttggaagtgtttcctgtctcggtaaaaggcaaaacgatgattgacatcggctcttctacagggggattcacggattgcgccctccaaaacggagctgagcggtcctacgcagtggatgtcggctataatcagcttgcttggaagctcagacaggacgagagggtcgtcgtcatggaacggacgaatttccgctattccgagccttccgatttcacagagggtttgccggaatttgcgacaatcgatgtttctttcatctcactccgcctcattctgccggttttaaaaacgctgcttgtaccggggagcgattgtatcgcactggtgaagccgcaatttgaagccggacgggaatccgtcggaaaaaaaggcattgtcagagatcccggcgttcatgctgacgttctccgccgcatgaatcaatttgccgcttctgaaggatatacagtgaaaggactgtccttctcaccgattacagggggagacggcaatattgagtttctgcttcatctggaatggggcggagaagacggaaacggcgctgaactgccggaagaagatattctccgtatcgtccgcgaagcacatgagacattaaaagccaaaaagacagatgtaccggaataatagggggctattattccttttttctgccatcatgtactttttatcaagaagcggttaacataatgacaagaacagcttgaaaacagaggtgcttacatgacaaaaggccaaaggcatataaaaatcagagagcttattacaagccatgagattgaaacgcaggatgacttagttgacatgctgagagaagaaggatataaggtaacccaggcgactgtctccagagacattaaagagctgcatctcgtaaaggtgccgacgaacaacggctcctacaaatacagcctgccggcggatcagcggttcaatccgctgtcaaaactgaagcgttcattaatggatgcgttcgtaaaaattgactcagcaagccatatgatcgtattaaaaacgatgccggggaatgctcaggcaatcggcgctctgatggataatctcgaatgggaagaaatcatgggcacgatctgcggagatgacacgatcttaatcatctgcaggacgcctgaagatacggaaggcgtacaaagccgtcttttggagctgctgtagcgtaattatcagataaaaggtggaatgctgtttgttagctgaactatcaataaaaaactttgccattatagaggaactgacgatttcgtttgaacgggggctcaccgtcctgacgggagaaacaggggccggcaagtcaattattatagacgccgtttccctattagtcggcggacgcggctcgtccgaatttgtccgttacggtgaaacaaaggccgagcttgaaggactgtttctattggacagcggtcatcccgtttttgaagtatgccgtgagcagggaatagacgcatctgacgacatgattgtcatgagaagggacatcaatgccggaggaaaaagcgtctgccgtgtcaacggaaaattagtgacgattgcggctttaagggaaatcggcagacttttattagatattcacggacagcatgataaccagctgttaatggaggacgacaaacacttggagcttttggataaatttgcgggcgctgaggccgaatccgcgcttcaggcttaccatgaaggctatgagcgttatatggagctgctcaaaaaagtgaagaagctgtcagaaagcgagcaggaaatggcgcatcggttagacctgattcaatttcagcttgaagaaatcgagtcggcgaagcttgaattgaatgaagacgaacttcttcaggaagagcggaagcagatatccaactttgaaaaaatttatgaatcattgcaaaacgcctataatgcgctccgcagcgagcagggggggcttgactgggtcggaatggcctctgcccagcttgaagatatttcggatatcaatgaaccgctgcaaaagctgtctgaaagtgtgtcaagttcctattatctgctggaggatgcaacctttcaaatgcgcaatctgttagatgatctggaatatgacccggaacggctgaattttattgaaacccgtttaaatgagatcaaacagctgaagcgcaaatacggagcgacggtagaagacattttggaatacggctctaaaatagaagaggaaatcgatcaaatcgagaaccgcgacagccaccttgaagccctgaagaaggaattggagtcggtcggcaaagatgtggccgtagaagccgccaatttatcaaaaatcagaaaagcatgggccaagaaactggcggaagcgattcatcaggaattacaaagtctgtatatgggcaaatcaacgtttgatacggaatttctcgtgaaaaccgatccgtcagccagtgaagcaccggttgttaacgggcagcccgtgcagcttacccaaaaggggatcgaccttgtgaagtttttaatttcaacaaacaccggtgagcctttaaaaccgctgtcaaaggtcgcttccggaggcgagctttcaagggtgatgctggcgatgaagagtattttttcttcccagcaggatgtcacctccatcatctttgacgaagtggacaccggtgtaagcgggcgggttgcccaagccatcgcggaaaaaatccataaagtatcgaccggttcacaggtgctctgcattacacacctgccgcaggttgccgctatggcggatacgcaccttctgatcgcaaaagaattcaaagacggacggacgacaacgcatgtcacgccgctttccaagcaggataaggtagcggaaatcggccgcatgattgcgggtgttgaagtgaccgatctgacaaaacggcatgcacaagagcttttaaaacaggccggacaggtaaaaacgacaggataagctgctgatacaggcagcttattttttgttccatttctctaacagtgtatccaatgtttttcttcgtatgccggttataaatcaagcgcaggaaggcaaaagtatagatgtagcagaaaaagaaagtggtgtgggataggagcgaggagagtgaaggaatgaatgcacgataacatgaggaaagcaataggtgtaattctccttgtttctttactaagtgtaggcttttttaagccgtttaaagaatatttactgataccgtcagaaatgagcgtctttgaaaaccagacacaggccgttccggtcaatgcatcaataagcgctgaaaagggcgaattatcagaagcctttacgctgaaagaagagcacggtcatgcaaacataacagggcaaacacaaggcaggtcagaagtagtatatgatcttgccggatttcccattaaaaaaacgaaagtgcgtgtccttcctgaattgaaggtcattccgggcggacagtccatcggtgtaaaactgcattcagtcggtgttttggtcgtcggttttcaccaggtgatgacaaaggatgggaaaaagtctccgggagaacaagcgggtattgaatctggcgacatcattattaaaatgaacggacataaaattgaaaaaatgagcgacatcgccccgtttattcaaaaagcgggcaaaaccggtgaatctctggatttattggtgaaacgcgataagcaaaaaatcaaaacaaagctgattccgacaaaggacgaagccgaggggaaatatcgaatcggcctttatatccgtgattcggcagccggcatcggcaccatgacattttttgaaccgaaaacaaaaaaatacggcgcattgggccacgtcatctctgatatggatacaaaaaaaccgattgttgtagaagacggagaaatcgtccgttctactgtaacatcgattgaaaaaggaaaaggcggcaatccaggcgaaaaactggcaaggttttcgtcagaacggaaaacgatcggcgatattaaccgcaacagcccgttcggcatttttgggacactgcatcagccgattaaaaacaacatttccgacaaagcgcttccgattgctttgtcaaatgaagtaaaaaaaggacctgcgcaaatgctgacggttatcgaaaacgataaagtagagaaatttgatattgaaatcgtcagcaccacgccgcaaaaattcccggcgacaaagggaatggtattgaaagtgacagatccgaaactgctgaaaagaaccggcggaatcgttcaggggatgagcggaagcccgatcatccagaacggaaaggtcgtcggagccgtaacccacgtatttgtcaatgatccgacaagcggctatggcgttcatatcgaatggatgctgtctgaagcgggtgttgatgtttacgggaaagacaaagcaagctgactgccggatgatccggcagtttttttatgtgatgcgttcttcacttctttccgggattcatgtaaaataagacatgaagatttttcgacaaattcacgtttcctgatttgtcaaacttaatttttagtcgaaaaacctagaaaatgctagaaaaacaaagatataccactattattggtaaatatggattttttaaaaggggaagtagtggttttgtcgaatgtaacatatagcagtcaaatgggttgcgtcctgttaatacattgggggaggaagaaacgtggagaaaattaaagtttgtgttgctgatgataatcgagagcttgtaagcctgttgagtgaatatatagagggacaggatgatatggaagtgatcggcgttgcttataacggacaggaatgtctttctttgtttaaagataagaatcccgatgtgctcgtgttagacattatcatgccgcatctggacggacttgcggttttggagcgtctgcgtgaatcagagcttgagaagcagccgaacgtcatcatgctgacggcattcggtcaggaagacgttacgaaaaaagccgtcgatttaggcgcatcctatttcatcctgaagccgtttgatatggaaaaccttgtcggccatatccgccaggtaagcggaaatgtcagcagtgtcacacaccgtgcgccgtctgcgcaaagcagcattatccgcagccagccggagccgaagcggaaaaatctcgatgccagcattacaagcattatccatgagatcggtgtgcctgcccatatcaaaggctatctttatttgcgtgaagccatttccatggtgtataacgatattgaactcctcggcagcatcacaaaagtcctttatcccgacatcgccaaaaaattcaacacgaccgcaagccgtgtagaacgggccatccgccacgccattgaagtcgcatggagcaggggaaatattgattccatttcttcactgttcggatatacggtaagcatgacaaaagcaaaaccaaccaactcagagttcatcgcgatggttgctgacaagctgagattggagcataaagcttcgtaacgcaagcctttggctaaatgtctttttgcgccttctattccgtgcatgaacgcggaagagaaggcgttttgagattttgctgacgaaaacaatgggaaccactcacgccggtacttgttctatacataaatacgggaactgccgtctatacgtataataccggagctgatattttaatgattttgccgtctctgaaataaaagcgggggatgcggcggcttaacacagaaaggacttcgtagctgatcgtaccgagcatttcggcaatttcatcaacggaaatctcggctccttgttgtttgccgtagatgacgacttcttctccttgtttgccctcattctcacctaaactgaccattatcatatccattgtcactctccccgccaccggcacccgtctgccgcggtgcagaataaacccgcggttggacagggcgcgggagtaaccgtcagcatagccgatcggaatcgtcgcgatgatttcacccggttcggcgatatatgtggcgccataactgacggtccggggatctgtcaccatagctttcacataagcgatacgcgcctttaaacttagtgcgggtgtgagatccacgaggttcagttcctttatcgaggcggacggatataaaccatataacccaatacctaaacggatcatgtcggcgctgaattccgggaatgcgatagcggcggctgtattgcacatatgcacggtaggcagcgtaatgtcttgattttttaaaaagcggagaaagctgataaacttttcgtgctgcagcatcgtcagctcagtgtccggttcatccgctgttgaaaaatgtgtaaagatgccatcccatgacaggtatgtactcgacttgagcgctttcaccactgctaaaagatcttcttctgtgcgcacacccagccggcccattccggtatccacattgatatgaatggacagccgtttcgactctgcttctttttccaatatccgattcgcttttttgatccagctgacctgaaacgctgataatgtgatgttccaaacggcagattttttcacacagctgagagctgtgaagccgagcacaagaataggcgctttaattcccgctctccgtaacacaattccctcttcgacgctggcgacagcaagctcgctcgccccgctttccagtgcctgccgcgctacttccacagagccgtggccataagcgttcgcttttacgacggccataattttagacgtattcggaatatggcggcggatcgcccgtacgttcttttttatcgcatcaaggtcaacttcaatccaaacttcccggcaaagttttttcatcacgattccttctttccttaatgagattcagtactcatgctttcaatctgcattctattcatctttaactgaaatcattcaaaacatgagaaggtgaccgctgatgtttaaaatcaagttttcgggaaagcatgcgcctgctttatttatgcagtaagggcagcatggcggcccttacaatgactttacaatattctgatctgaaaattgatgttcaaacattttggactggcttacagcattgttttgaatgacaatgccgatatttccccctccggcaccgaaaacggtttttgatgcagtcagcggactgatggatatggcgccgccaacattgacaactccgtttcctgatacgttgtttatcgtaatcgggcaaccgctcattctattttttctcctttctctcacagtctactaactatatgtacgctgtgatatggaataagattaaacaaaacggcaaaaagaatccggctgctgccagccggaaagggagggaaatacggatatcataatgttttcgttacattttgatcagagtattgagagtttgaagattgagatgtgctggattgattcatttgcaggaccatacctgtatttccccctcctgagccgtagacggtttttgatacggttaaaggacttatcgaaaacgcaccgccgacattgacaaccccgtttccggaaagactgttaatcgtaatagggaaaccagccatcatatacggtctcctttctattaatctatttactatatgtacgctgtgtgttagaaataggagtaaacaaagcggtaaaaacttgtgaatcaaaaaaactgccggacatccggcagttttttagtctacttttcaaacggcacccagccgcctgtattctgaatcatttcccataacggttcaggaagtcggtatttatcaatttcagatgcctgaatggctttttcgatttcctgttcgcggccttctttgaccagcaccgcccattcggggttaatcaaaatgacacgtcccagagccaccagcggaattccgctttctaatacggcaagcgcttcgtccgcggtatagatggaaccgacggccatcagcggcactttatggccgacgcgttcgtttaataaatccatccgggtccgtgaagtatccgcgccgcggcgggctttggaattgacatccatcagtgaaatatgcagataatccaagttctcttccgcaagcgcgtcggcgagcatgaatgtttctttcattgtaagccccggtgtttccggctcttccggtgacaggcggtagccgagaacgaatggattttcagcgtgtgtatcaatcgcctgtttgacagcgtcaacgactgcaagcgggaacgcaaggcgcttttcatcgcttccgccccagcggtctgtgcgccggtttgttttcggtgaataaaattggtgaatcaggtacccgtttgccccgtgaatttcaacaccgtcaaagccggcttcaatcgctctgcgtgtcgcttcgccgaatgctttcacgatgtgctcaatttcttgttctgtgagagcacgggacgtttgtctgccgtcttcttctgagccgctcggactgacgacgtcgttgtttggcacgagttcaggagggcattccaagcctccgtggtgaatctgcacaacggctttcgctccttgagactggatcgcctgagcgagttttttcaagccgggaatgtgagaatcatcatagatgccgggctggcctggaaacgctttgccgtccggcgttacgtttgcacatgccgtaatgaccatgcccatttcttttgaacggggagtaatgtagcttaattcacggtcggaaatcgttccgtcatcatttgatgaatagtgtgtcatcggtgcgactgaaatacggtttggtatagtgacaccgctttcgaacgtaaaaggttcaaacagcggtttataagtttgcttcatcatttcgccttcttccttaggagtttaactcgtccgtattctagcttatgttttcattgtgtgcaattattttgcttgttcttcttcctgaggttatgaccggctgaaccatttaaacgaatgaaacggttttctccgttccttttcaggatctttatatcctcctgaaatttgatggccgatcgagctgaatatgacagcggcggcgaagaggagaatgatttttttcatatgcatatcttctttcttatcttttacatggttatttataagcatacgcttgtgcgaaaaaaccgtcaatttgtttattcttttttccactttcctgcggcgaatatcgttccgatctgaatcacaacacttaacagagcgcacactgccacaactgtgttgctgtccatagaagacaccctcctttttgttaggttgatgtatcatatgacggctgtctctgttttgacaaaaccgtaatgcggtgtttcatatttttcaacacaaaaagggcgcttttttaagcgcctttacttttttttcagccggttcaaagcgatttgaacggcgatggcgtcatccaggtagccgatcggaaacatgtaatccgggataacgtcggtcgctaaaatataatacagcagcgcgctcccgagaatcgcgcggtcttcagccggtgttgattcatccatatactgatgatgcatgtttttcaaatggtcaataaaagggccgacgctttcttcattgtccattttcttttgaaactcatcgcaaatcaggcgatggccctgctgggttttggcgtattgttcatatctggtcagttcacgctcaatttgctcccgggaaaaaggctgatcaaacatctcggccatattcagcatatcctgaatcgcgtgcatcgggtcttgcggcgcagcttctttttcatggccgatgtctatgcctgacgcctcaagcaattcctccagcggggtgcggaggtgttttgaaaattcctgaagatgctttaaattggccttctgtttgccgttgataatccgggagatagtggccgtatcaatgtttgttaaggcgccgagttttctcatggagagcgagtgcttatcaagcagtgattttaaaaggggtcccagtgtcttatttttattttctgtcaagggtgtcacctcgtttccgccggaatgatgatcgtcaatcaataatttttgcagaaaaggtaccttttctgtgctgctgaataggatagtgtagattcaacggcacaacatgttgaaaagacatcaaagaatggagagaaacgaacatggcttggttattgattttaggtttggcagtgtcctcaagcattgataatttaggagtggggatgtcatacggcatcagaaaaatcaaaatatcgcatgcgtcaaatatgatgatcgcttttatctgttttgtattcagttatatcggaatttatttcggcaaatggatttcagccgttttaccgggctttcttcctgtattgctggcggcgtttattttatctgtcatcggtatccgcatcattctgctggctgtgccgagaaaaacagcgcgtgttggcgggtcaggaaaaaaaggccgttttgccggtctgctgcaaaatccggaggcagcggatgccgacggttcgggagaaatcggtatattggaatccttggttctcggggtggccgtatccgcaaatgcgctgaccaacggattaagcgcggggttgatcgggctttctcccgctgccatttccattactgcggcggtcggaagctttctgaccatatggatcggctgctcgcttggaaaaaaagccgcttcattgcgcatcggttcttttcacgtcggacagttcagcacggtgctgagcggagtgattattctcatcattgccgccaatacgctgctcttttaagttgtcccgttcattttatgaaaagctcaaaataaatatgaatgtttctattcgggagagtgcatgacgcggctctcttttttgccgatctgatattttttcaaaatgaacagaaagtcgtccgtttccgttaaattctgcatattcggccttcagacagaacctttttcatagactgatcagcttgttttctttctaagttcaggtaaacagcaggtcagatagccttcattccaaagatggaaaaacgctggaggaatggaggctccctttacaaatcggccattctgttcaaagataaagccgaatgagaaaacgtgaggtgatctgtgtgaagtctgccatacttctgatcttcaccgcatggctgttatcaggctgcgagtataccgcggaggctgatgcggcgccgtcatttacacaggaaggaacatttataaaagcggccggaaacgatacgatcgcggtcgaaattgacggagaaaggcaagaggtgaaggtgcctttcgctaagcggtttgaatgtcagtcgctgcctgaacatacggcggtgcaaatcacctataaaaaagagagcaacggacaattacggcttgagaaactgaaaaaagaaacagatatgtgaaaacggggaggaaaaaaacgtgggtttactgacaaaaagcgctgctgccttcggtgccgctctgcttctgcttgcgccgtccgcttatgcagccgaacctttgcaagggaaaaccatctatatcgatgccggacatggcggagaagacagcggagccggcggaaatggactgcttgagaaaaacatcaatttagcggtgtcaaacaaggtgatcgccaaattggagacagaaggcgcaaaacctgtagcttcaaggactgacgatacttttttacgtttggacgagcgggtggcgaaagcgagcgccagccaatccgatttattcgtcagcctccatacgaattcagccgtatcaacggcatcgggcacggaaacgtattttaattcgacatatgaaggagcggacagcgaaaggcttgcttccgacattcagcagcagcttgtcacgtctttagggatgagggacagaggcgtaaaagaagctcctttttatgttattacatattcaaagatgccgagtgtgctggctgaattaggttttatcacaaatcctcaagatgcggacaagctgaaaagcgataacggacaagagcacgccgcggacgccgttgtaaacggaatcgaaacctattacagcggacggtaatgataaaatatgtgtaaatagcgccctcctgatgtgcataacgattataatagagaaaaccgatgacaaacatctgaggtgacacatatgacgaatatttttgcccaccggggggcgtcgggcgactgccctgaaaatacgatgcccgcattcaaaaaagcgattgaggacggggctgacggaattgaacttgatgtacagatgacaaaagacggccggatcgtggtcattcacgatgaaaccctcgaccgcacgacatctttgaaaggatttgtgaaagatacggcgtatgacaaaatcagaaccgccgatgccgccggaaaatggaaagattcttttaaaggtgtcagaattccgcttttgtcagatgtgctgcgttttgcggaacgtgctgattttctgataaacattgagctgaaaaacagtgtattccgttacgaaggaatggaagaagaagtgatcaaaaaagtcagatattacggactggaaaagcgcgttattttttcttcatttaatcatgagagtctcgcggtgtgccacgcccttgcgcctgaaattgaacgggcggtgctgacaatggatgtgctgtaccggcctgaacgttatcttgccgccattcccgcttcgggttatcacccgaagctcggcacgccggcggtcagcgctgaagtgatcacacatcttgcaaaacaccaagcggcgctccgtccgttcaccgtcaatcgtcctgaggatatgaagcggctgatgaaagcggggatagacgcgatttttacagattatccaaagctggctgtttctataaaagaagaatgccgcagctgagaagactggtcagacagtcttctttttttatgggcgggaaaaaggcggtgcactcataactcggtcagccggttcatatattgtaacagggcgttttgtgtaagcgttatcttttatcttattgaaagtgaggaaaaattgtgggaaaaacggttatcgtcagtgcggcaagaacgccgttcggaaaattcggcggcgcattaaaagaggtgaaggcatccgagcttggcggcattgccataaaagaagcaatcaagcgcgccgctatcagtgaaagcgaagcggaaggagcggtgatggggatggtcgtccaggcgggtgccgggcagattccggcacggcaggctgcaagatatgccgggcttccgtggtctgttccggctgaaaccattaataaagtctgtgcatcagggctcagagccgttaccatctgtgatcaaatgatccgggcgaaagacgcggacgtgctgattgcaggcggaatggaaagcatgagcaacattccgtacgccattccggccggccgctggggtgtgaggatgggggacggggtttttcaggatttaatggttcatgacgggctgacctgtgcgttcgaccaggtgcatatggctgtccacggaagcactgcggccaaaaagtacggcatttcccgagatgaacaggatcattacgctcttttgagtcagaaacgcgcggctgaggcggctgatgcgggcaaattgcgtgaagaaattgtccccgtcacctggaccggcaaaaagggcaaacagcatatcgttgaagcggatgaggggctgcgtcctgatacaagccttgagcagctcgcagcgctcaagccgattttcacagccgacggaacggttacagccggaaacgctcccggtgtaaatgacggggccggagcatttgtgctgatgtcagaggaaaaagcagcaaagcagcatgtcaggccgctcgcagcgatacttggctttgcgtccgtcggactggaagcgtccgagctggcaagcgcgccgggagaggccatcagccggctcttgaaaaaaaccggactgtccgttgacgatattgatttgtttgaagtaaatgaagcatttgcgtccgtcgtgctcgtgagtgaaaaaatagccgggttcagccgggagaaagtgaatgtaaacggaggggcaatcgcgttcggccacccgatcggcgcaagcggagcgagaatcgtcatgagtttaatatacgaattaaagcgtcgcggaggggggttaggcatagcggctatatgcagcggagcggctcaaggagatgccgtcctgctggaggtgtactgatcaaaggagggagcgccggatgaagatgaaaacaatcatggtcgcaggtgccggtcagatgggggcaggcatcactcagacggctgcagaagccgggtttgccgtcaagttatacgattgggagccggaaacggtaacaaaaggtcttcaccgcataaagacaaacctggagaaagagcaggcaaaaggacggaagtcacagcaggagacagatgccgttttcagccgtatttccccggcggagctcacagaagcgggagatgctgattttatcattgaagccattgccgaaaacaaaaaagcaaaagcggaattgtttgacacacttgataaaatctgtccccctcatgccgtattggcaagcaatacgtcttctcttcctattacggagcttgccgcggccacaaaaaggcctgaaaaagtaatcggcatgcattttatgaatccggttccggtcatggagcttgtcgaagtcatcagaggactcgccacatcggaagaaacggcggaaacagtaaagaagcttgccgtccggatgaataaaacccctgtcgaagtcaatgacttcccgggctttatatctaatcgcatattaatgccgatgattaacgaagccgtttattgcctttacgaaggagcagcttcaaaggaagcgattgatgaggtgatgaagctcggcatgcgtcatccgatgggtcctttaacattagctgacttcatcgggctggatacgtgcctttccattatggaggttctctacgcggggctcggagatccgaaataccgcccatgccctctgctcagaaaatatgtcagcgccggctggctcggcaaaaaaagcgggcgcggtttttatgagtacggcagatgacgtaaagatcatgaggggagacggcagccatgcattttactgaagagcacatcatgatgaggaaaatggtgcgtgattttgcccgcaaggaaatcgcgccgatggttgagctcatggaatcaacagatgaatttccggagcggctgattaaaaaaatgggcgaagcgggattgatgggcattcccgtcccggaagcttacggcggggcgggtgctgatacaacatcttacattttagcgattcatgaaatatcaaaagtcagcgcggccgtcggcgtcattttgtccgtccacacatcggtagggacaatcccgattttgcatttcgggacagaagcccaaaaacaaacgtatattccgaagctggcagcgggcgaatatattggagcttttgcgcttactgagcctcactccggatctgatgcgggaagcctgagaacaacagccgtgcgaaaaggcggttcatatattctgaacggttcaaaaatctttattacaaacggcggagcggcagatctgtatctgacatttgccataaccgatccgggtaaagggagaaagggaatttcagcgtttattgttgaaaaaaacacacccggtttttctgtcggaaaaaaagaaaaaaagctcggattgttaggttccaatactgccgaattgcagtttgatcaagcggaaattccgattgaaaaccggctcggcgaagagggcgagggtttttcaatcgccatgaaaaaccttgacgtcggacggatcggcatagcggctcaggcgctcgggattatcgaagcggcgctcggctgctcggcggagtacgccaaaacccgcagccagttcggcagacccatcgcttcgaatcaggccgtttcatttaaattatctgacatggcaacgaatgcggaagctgccaaattattggtctatcatgcggctgatctgtatcagcgagggcttccgtgcggaaaagaagcatctatggcgaagcaattcgcgtccgatgcggcgatgaaagcggcggtggaggctgtgcagattcacggcggctacggctatatgaaagagtatcccgcggagcgtttatttcgggatgcgaaagtcacgcaaatctatgaaggaaccaatgagattcaaaggctgattatttctaagtatcttcttcaataaaaagtgcgcaaaggagcgaaaccatggaatcttattctcccggtttagatggcgtcattgcggtggaaacggggatttctttcctggatacacagcagggcagtattttaatcaaaggccacgatctgattgagctttctaaaacggccggctatatggacattgttcatctcttattggaagacagacttcctgatgcgaaagagaagaaggcgcttgaagaagacgttcggcgcggcggacaccttcccgaggaaatcttgcgtatatgccgtctgctgcccgaacgtactcacccgatggacggactgaggacaggtttgtccgcgcttggaggctttgataaggatattgataaccgcacctcttctgtaaatcggcaccgtgtccgcgggctgataggcaaaatgcccaatctgaccgtcaacagctatcgagtcatcaacggactggagcctttagcgcctgtcggaaccttgtcgtacagcgcaaactttttatatatgattaccggaaaaacgccgtcctccttggaagaagaaatattcgaccggtcgcttcttttatacagtgagcatgaattgccgaactcaacgtttacggcccgtgtcattgcttcgacgcaatcggatatttacggcgctctgaccggagccgtcgcctcgcttaagggaaaccttcacggcggagcgaacgaagcagttatgtacatgcttgaggaagcgaaggatacagacgggtttacacacttattaactcaaaaactcgcaaacaaagaaaaaatcatgggcttcggccaccgtgtctacatgaaaaaaatggacccgagggcgctcatgatgaaagaagcattgaaaaaactgtctgatctttcaggtgatttccgtctttatcatatgtgtgaagcaggagaaaccgtcatgcgggagaaaaaaggcctttatccgaacttagattactacgcagcgccggtctattacatgctcggcatcccgatcccgctgtatacgcctatattcttcagcgcacggacggtcgggctgtgcgcccacgtcattgaacagcacagccgaaaccggcttttccgcccgcgtgtccgctataccggagcgcgtctgtaaacagatgagaaaggaagatgaaaacatgacagaaccccgccgaatggacgccgtaatcgaagagatttctgactacgtgctccatcaggagattgacagttcggaagctttcactacggcaggacatgtgcttcttgatacgataggctgcggaattttggcgctcagctatcccgaatgtacaaagctgctcggcccgattgtcccgggaacctccgtgcccaacggcagcagagtcccgggcacgccttttgttttagacccggtcacggctgcctttaatatcggctgtatcaacaggtggctcgattataatgatacgtggcttgcggccgaatgggggcatccgtctgacaatctcggaggcatattggcttgtgcggattatatatccagagtgcggatttcagaagggaaagaaccgcttaccgtgcgtgatgtgctttgtgcaatgatcaaagcgcacgaaattcaaggaattctcgctttggaaaacagtttaaacagagtcgggcttgaccatgtgctgtttgtgaaggtggcgactgcggctgtttgcgcacaaatgctgggcggctcaagagaggaaatcaataacgccgtatctcacgcttggattgataattcaagcctcagaacgtatcgtcatgcgccgaacaccggatcacgcaaatcatgggcggccggcgacgcgacgagcagaggcgtatacttggcccttatggcgcaaaaaggtgagatggggtacccgacggctctgaccgcatccgggtggggatttcaagacgtattatttaaccggcaggaaatgaagcttgcccgcccgcttgggtcctatgtgatggagaatgttttgtttaaagtatcctacccggctgaattccacgcccagacagcggcggaatgcgcggtccggcttcatccggaggtgaaagaccgcatcgaagacattgacaggatcacgattatgacccatgagtcggcaatccggattatcgataaaaaagggccgcttcacaatccggctgaccgggatcactgcctccagtatattacggcaatcgggctgcttttcggagatatcacggcggatcattatgaagaggaaacggcgtctgacccgcgaattgatacattgcggagcaaaatggaggtgacggaacataaagcgtactcaaaagattacttagacccgaataagcgatccatctcaaatgccgtacaggtgcattttacagacggcacggctacgggacggattgaatgtgaatatccactcgggcaccggttccgcagaaaagaagccgttccgaagattcttgccaagttttcagcaaacatcagcactcatttttcattgaagcagcagcggaaaatcgaagaggcctgtaaagatagcggccgaatgcagaagctcagcgttagtgaatttatggacttatttctcatataaaataggagggtgacaaacatgacgtggatcgtcagcaagcagtcgtctcaagaggagcttgcagagcggttccgtgcgctgatggcagcgccggatctattgcagattcccggcgctcacgatgcgatggccgctcttattgccaagaaaacgggtttttcggctctttatttatcaggcgcggcttacacggcgagcagagggctgcccgatttaggcatcatcacgtcggcggaaatggctgaacgggttaaagatctggtccgctcgtctgatctgcccgtcctcgtcgatattgacacgggtttcggaggcgtgctgaatgccgcccggacggcgaaagaaatgtatgaagcgcgcgcggccgccgtccaaatggaggatcagcgcctgccgaaaaaatgcggacatctgaatgggaagcagctcgtgccgattgaagaaatggcgcaaaaaatccaagcggtcaagcgggccgcgccgactcttcttgttattgcgagaacagacgccagacagcaggaagggctggagggggcattaaaaagggcttctgcttatataaaagcgggtgctgacgctgtttttccggaagcgctccaatccgaaagtgaattcagagcgttttccaaacaaatcagtgtgccgattctcgcaaatatgactgaattcggacaaacgccgtattacagtgctgatgaattttccgatatgggctgtcagatggtcatttacccggtcacgtcactcagaacggctgccaaggcttttgagcgtattttccgccttctgaaagaagaaggctctcaaaaagaggggctttcggatatgcagacgagaaaagaattatatgaaacgatcgcttacgatgactatgaagaactggatcaatccattgccaaaacgatactgccggacgactgaaaaagcccttttttgcaagggctttttttacagcttttttttcctgaaccgcgggctgacttgattgcgtttccgatctctgtacaaaataaacccggccagaacataaaggccgaacaaaaaaaacgccaatccggccgccccctgaagaaaaagggacggaaacggggaaaacgcatgcccgaataatgcatctctcatcagcttaatgccgagcgccgcgacagcgccggggaggaccagaatcaaaagcgcaacaagccggctcatattcagaaaacccctttacgatatgatttactttattgtccaatcgaaaaaatattttgtcaagagatcaaaacgtggtaacataggggttgtgcaaattattgcaacgggaaatacaggtgtgcaaattttttcatataaaggggtatcgggatgcagaaggtgctgattataggtgctggtaaaggaggcacggcgctcctacagattttgatgaaaacaaaactgatccggattattgcggtggttgatcaagatccggaggcgcaagggctgcaagaagcccggagatatggaattgcaacctcatcagattggaaaccctacataactgaagatatagatattatcatccatacaacaggcgataaagcggtcatggatgagctgctccatgagaaaaaagaacaaaccatcgtcatgccgggaaaattggcgtacatggtgtttcagctgatggaggaaaaacagcagcttatccaaatgctgaagtcgcagacgtataagcatgaccggattttcaattcaacgcacgacggtatgatttttatagacgtcaacgaaacgatcattttatttaatcagatggcagaaaaaatggtcggccgaaaacgggaggatgtcatcggccgccaaattaaagatgtagtgccgaacacaaagctgccgcggattctggaaacgagagagccggaatataaccagaagcagcttctcggcaagcatctgcagattgtcacgacaagactgccgatcattgatgaaggcggaaaacttctcggcgcgttatgcgtgtttaaagacatcaccgacgcagttgaactggcggaagaggtcacgaacttaaaacaaatccgcaccatgcttgaagcgattattcaatcgtcagacgaggccatttccgtcgttgatgaaaacggcatcggaatgttaatcaacaaagcgtatacaaaaatgaccgggctgtcagaaagcgaagtcatcggaaaacccgcttccaccgatatctcggaaggggaaagcatgcacctgaaagtattggggacaaggcggcccgtgcgtggtgtgaggatgaaggtcggccccaataaaaaggatgtcatcgtaaatgttgcccccgttattgtggacggtattttaaaaggcagcgtcggcgtcatccacgacgtgtcagaaattaaaacgctgactgctgagctgaatcgggcgcgccagatcatccgcacgcttgaagcgaaatacacgtttgacgacattatcggcacgagtgaacaaatgctggtcgcccttgaacaggcgaagctcggggcgaaaacgccggcgacgattctgctgcggggagaatccggcacagggaaagaacttttcgcccacgccatccataatgaaagcgaccgaaaatacaataaattcattcgggtcaattgtgcggccctgtctgaatccctgcttgaatccgagcttttcggctatgaggaaggcgcgtttacgggcgcgaggcgcgggggcaaaaaaggactttttgaggaagcgaataacggcagcattttcttagatgaaatcggagagctgacccaaagcacccaggcaaagctgctcagagttctgcaggaaaaagaaattatcagagtcggcggcgcaaaagcgatttctgtcaatgtcagaattatcgcagcgacaaacgtcaacatcgaaaaggccatggcggaaggcgcgttccgcgaagacctgtattaccggattaaccgctatccgatctcaatcccgccgcttcggcagcgcaaagaagatattgaagcgctgagcattcggctcattgaaaaaatcaatcaggattacggccgcaatgtaaaggggctcacgccgaacgcgctgcgagctttatcagcctacagctggccgggaaacgtacgggagcttgaaaatgttctcggacgggcaatgatatttttagagccgcatatggaacggatcgaacagcagcatctgcctgttttcgaatcagagctgaatgacaaaaacggcacccaaagtgattttccggatgtagaaggggaaaagctgtctcaggctgttgaaaaatttgaagcgcacatcattcaaaaaacgcttgaaaagcataaattcaaccgaaccaaaacggcgaaagcgcttggtgtcagcattcggaatctgtactacaaaatggacaagtacggccttgcaaatgacggcatgcaataaattgcagagaaagcgcaaaccgctgcatgttttcttgaaaaaagccggaataaaccctttcgcatatttggcacagaacttgcattgttaaaagcggattcgcacaagaaaggtggtacaaaatgaagctgagagacctagttgaaaaagccgcggcaaaaaacgcaaaaaccattgcagtggcccacgcagcagataaagaagtgatccacgccgtcaaaatggcggcagaacacttgtcggcacgatttttactgacgggtgacagcggaaagctgaaagagcttctggcaaatgagccgaagttcaatgctgacatcatccacgccgattcaccagaagaatctgcggcaaaagcagtgcgcgcagtgcgtgaacaagaggcggacgttttaatgaaagggaatctcccgagctcaactcttctgaaatcggttttaaaccgccaggaagggcttcgttcaaaaagggtgttatcacatgtagccgtttttgaagtgccggactatgaccggctgatgtatgtgactgattcagcgctgaacattgccccgtctcttgaagagctcgggcatattctgcaaaatgcggttcatgtcgcacattcagtagggaaccctatgccgaaagccgcagtccttgcggctattgaaacggttaatccgaaaatggaggcgacgctgaacgcggctgcgatcgtccagatgtgcaatagaggacagattaccggctgcattgcggacggaccgcttgctttggataatgccgtatcccaagcggctgcgctgcaaaaagggatttccggaagcgtagcgggccaggcggatattctcttggttccttcaatcgaggccggaaatatgctttataagtcaatgatttattttgcgaaagcaaatgttgctgctgtcatcgccggtgcaaaagcgccgattgcattaacgagcagagcggataccgcagaaaataaactgtattcaattgcgcttgcgatttgcgcatcacaagaacagtaggaggaacgaacctatggaaatttttaaatatatggagacttatgattacgaacaattggtattctgccaagatgaacaatccggattaaaagcgatcatcgcgattcatgatacgacgctcggccctgcactcggcggaacaagaatgtggacatatgacagtgaggaagcggcgattgaagatgcactgagactcgcaaaaggcatgacttataaaaatgcggctgccggtttaaacttaggcggcgggaaaaccgttattatcggagacccgcgcaaagataaaaatgaagaaatgttccgcgcgttcggccgctacatccaaggcttaaacggaaggtatattacggcggaagacgtcggcaccaccgttgaagatatggacatcattcatgatgaaacagactatgtaaccggaatttctccggcattcggttcatcaggaaatccgtctccggttacggcgtacggcgtctacaaagggatgaaagccgcagcgaaagcggcgtttggcactgattcactggaaggtaaaacaattgccgtgcaaggcgtgggaaatgtggcttacaatctatgccgccaccttcacgaagaaggcgcttctttaatcgtaaccgatatcaataaagaatctgttaaacgtgccgttgaggacttcggcgcccgcgccgttgatcccggcgacatttactcacaggcgtgcgatatttatgccccgtgtgctctcggcgccgtcattaacgatgacacgattaaacagctgaaggcgaaagtcattgcgggggcggccaataaccagctgaaagaaacacgtcacggcgataccattcatgaaatgggaatcgtgtacgctccggattatgtcatcaatgcaggcggcgtcatcaatgtggccgatgagctttacggctacaacgctgagcgtgctttgaaaaaggttgagggcatctatgcaaacattgagcgggtgctcgatatttccgcgcgtgacggcattccgacatacttagcggccgaccgtctggctgaggaacgaattgagcgcatgcgccgttcaagaagccagtttctgcaaaacggccaaagtatattaagcagacgataggaatttgatctggaggtatgaaaatgttcgaacaggaaaaacgcattctcattctgaatccaggctcaacatcaacgaaaatcggtgtctttcacaatgaacgctgtatctttgaaaagacgctgcggcatcccgaagaagagctgaaagcatttaacggcattatcgaccaatacgaatttcgaaaaataagcattcttgagtctttgcacgaacagggcatcaacatttcaaagtttgatgccgtttgtgccaggggcggcctgctcagaccgattgagggcggcacatatgaagtgaatgacgccatgatcactgatttgaaaaacggctacaacggccagcatgcttctaatctgggcggaattattgccagggaaatagcagacggattaaatatccccgcgtatatcgtcgatccggtcgtggtggatgagatgactccgctcgctaaagtatcaggaatgcctgaaatcaagcggaaaagcatttttcatgctttgaaccaaaaagctgttgcccgtcatgcggcggcgtccctcggcaaacggtatgaacagatgaagatgatcgtcactcatatgggcggcggcatcacagtcggggtccatgattgcggacgggtgacggatgtcaacaacgggcttcacggagaagggcccttcagcccggagcgtgcgggaaccgttcctgcgggtgatttggtggagatgtgtttttccggcaagtattcaaaagccgatatgatgaaaaaacttgtcggcacgggcggactctccggctacctggggacaacggacgcggtgaaggtggaaaaacgcattcaggccggagatgagcatgcgagactcatttatgacgccatggcttatcaagtagcaaaagaaatcggggcggcaagcgccgtattaaaaggaaaagtagacattatcgtcctgacgggcggattggcgtacgggaaaagtttcgtatccgccatcagatcgtacatagattggatttcggatgtactggtgtacccgggagaaaatgaactgcaatctctcgcgcaaggcgcgcttcgggttttagccggtgaggagcagttaaagcaatatcagatcggcgaaggagtgaaaacaaatggcgactgaatatgatgtggtcattctgggcggcggcacgggcggttatgtagccgccatcagagcggcccagctcggcttaaaaacggccgttgtagaaaaagaaaagctcggcggaacatgcctgcataaaggatgtatcccgagtaaagcgctgttaagaagcgcggaagtgtaccgaaccgcaaaggaagcggcagcattcggcattgaaacggaaggtgtctccctccgctttgacagcgtgcaaaaacgaaagcagggaatcgttgaccggctggccggcggtgtcgcccacttgatgaaaaaggggaagattgatgtattcaacgggtacggacgtatgctcggcccttccatcttctcacctcttcccggtacggtttccgtcgaatacgcaaatggtgaagaaaacgacatgctgataccgaaacaattgattatcgcaaccggttcaagaccgaaaatgctgccgggtttagaagcggacggtacatatattctgacatcagatgaagcgcttgagcttgagcgtctgccccaatccatgttgatcgtcggcggcggtgtcatcggaattgaatgggcatccatgctgaacgatttcggcgtcaatatcactgtgattgaatatgcggaccgcattttgccgactgaagaccgtgatatttcaagcgagatggaaaaactgttaacgaaaaaaggaattaagattgtaacgggtgcgaaagtgcttccggatacattggaaaaagcggatggcgtttcaattgccgctgaaaagaatggaaaaaaagaaacgtatcacgccgaacaaatgcttgtttccatcggccgccagccgaacattgaagggatcggccttgaaaatacggacattgcagcggaaaacggttctatcatagtaaatgaagccggacagacgaaggaatcgcatatatatgcgatcggtgatgtcgtcggcggtctgcagcttgcgcatgtggcctcccgtgaaggcatcattgccgttgagcatatggcgggtcttaatccggctccgcttgatgccgctcttgtgccgaaatgcatttattcaaatccggaagcggcgagtgtcgggctgacagaagaagaagctgcccgaaaaggacatgaacttaagatcggaaagtttccgttcatggcgatcggaaaggctcttgtatacggagaaagcgacggctttgtcaaaatcgtcgccgatcggaatacagatgatattctcggtgttcatatgatcggcccgcacgtcaccgatatgatctctgaagcggggcttgccaaggtgctcgacgcgacgccttgggaaatcggccagtccatacatccgcatccgtcgctttcagaagcgattggggaagctgcgttagccgcagacggaaacgcgattcatttttaaaaggaaagaaggaggggtttgaatgactacaaaccgccatcaagcattagggctttctgacgaagaagccgttgaaatgtatagaaccatgctgttagccagaaaaatcgacgaaagaatgtggctcttaaaccgctcgggcaaaattccgttcgttatttcatgtcaagggcaggaagcggctcaagtaggcgcggcctatgccctaaaacgcgataccgactatgtgcttccgtactacagagatatgggggttgtgcttgcattcggtatgactgctaaggatttgatgatgtcgggttttgcgaaagcggctgatccgaactcaggcggaaggcagatgccgggccacttcgggcaaaaggaaaatagaatcgtaacgggctcatcccctgtgacgacgcaggttccccacgcggtcggaatcgcgcttgcgggacgcatggataaaaaggatatcgtctctttcgttacctttggagaaggttcttccaaccagggagattttcacgaaggggcaaactttgccgccgtgtataaattgccggtcattttcatgtgtgaaaataataagtatgccatttctgttccgtatgacaaacaggtggcgtgcgaaaatatttccgaccgggcggcaggctacggcatgccgggagtcacagttgacggaaacgacctgctggaagtttaccgggccgtgaaagaagcgcgcgaacgggcatctaaaggcgaaggacctacattaatagaaacggtttcctaccggttgacgccgcattccagtgatgacgacgacagcagctacagagaacgcgaagaagtagaagaagcaaagaaacaggatccgcttcttttatacaaagcatacttgcaagaagccgggcttctaggtgaagaagaagaaaaggccatgctggatgacatcatggctatcgtaaacgaagcgacagacgaagcggagaaagcgccatacgcatctcctgaatcaacgcttgatcacgtttatgcgaagtagggaggaatacttatgtctgtaatgtcttatattgacagtattaatgcagctatgaaagaagaaatggaaagagatccgcgcgtttttgtcctcggggaagacgtcgggagaaaaggcggcgtatttaaagccacggcgggtctctatgaacagttcggagaagagcgggtgatggatacgccgcttgcggaatcagcgattgcgggtgtcggaatcggcgccgcgatgtacggcatgcgcccgattgccgagatgcagtttgccgatttcattctgcctgcggtcaaccaaatcatttcagaagcggccaaaatacgctaccgttcaaacaatgattggagctgtccgatggtcatcagagcgccttacgggggcggcgtgcacggcgcgttgtatcattcccaatctgtggaggccatttttgccaaccagccgggtcttaaaattgtcatgccttcaactccttatgacgcaaaagggctgttgaaagccgcagtccgtgacgaagatcccgtgctgtttttcgaacataagagggcgtaccgcctgattaaaggagaagtccctgctgatgattacgtccttccgatcggaaaggcggatgtaaaacgcgaaggcagcgacattactgtcattacgtacggattatgcgtccatttcgctctgcaggctgccgagcgtcttgaaaaagacggaatttccgcgcacgtattagacttgcgtacggtttatccgttagataaagaggctatcattgaagccgcgtctaaaacgggaaaagtattgctgatcacagaagatacgaaagaaggcggtattatgagcgaggtcgccgccattatttctgaaaactgcttatttgatttagacgcgccgatcaagcggcttgcaggccctgatgttccggcaatgccttatgcgccgacaatggaaaaatacttcatgatgaatcctgacaaagcggaagccgcgatgagagaattagcggagttttaaagacgtaaggaggtttttgacatggcgattgaacaaatggctatgcctcagctcggagagagcgtgacggaagggacgatcagcaaatggctggtatcccccggtgatcaagtgaataaatatgaccccatcgcggaggtcatgacggataaagtgaatgcggaggtgccgtcttcttttaccggtacgattacagaacttgtaggagaagaaggccagactcttacagtcggcgagatcatctgcaaaattgaaacggaagaaacggaaaccgaagaggcgcctaagcgggaagaagagcagaataccccttcagacaccgatgcaaaccgtcaaggtaaagaccagtcaaataaagcgcgttattcgccggccgtgctcagattagcgggagaacacggcattcagcttgaagaagttgaaggaacgggcgcaggaggaagaattacgcgaaaagacattcaaaagatcattgattcgggaatgcagcagaagtcggaagcaccggcgccggctgccgttcaaacaacgcaacaagcgccgaaacaacagcaaaaacaagcgccggcgccagctctgtcagccggtgatattgaaattccggttaccggcgtcagaaaagccatcgccgccaatatgcataaaagcaaaacagaaattccgcacgcctggacgatgatggaagtcgacgtcacgaacatgacggcgtacagaaacagcattaaagactcatttaaacaaaaagaaggcttcaatttaacgtttttcgctttctttgtaaaagcggcggcgcaggctctcaaagagttcccgcagatgaacagcatgtgggcgggagacaaaatcgtccaaaagaaagacatcaacatctccattgccgttgccacggaagattcgctgtttgttccggttattaagcatgctgatgaaaaaacgattaaaggcatagccagagaaataacggaccttgcgaaaaaagtgagaaacggaaaacttaccgcggaagatatgcagggcggcacatttaccgtcaataacacgggatctttcgggtcagttcaatctatgggcattatcaaccatccgcaggcggcgattcttcaggtagaatctatcgtcaaacgtccggttgtcatgaataacgggatgatcgcagtgcgtgatatggttaatctttgcctgtctttagatcacagagtgctcgacgggctcgtatgcggccgtttcctcggacgcgtcaaagaaatcttagaaaacattgacgaaaatacttcagtctattaaaaaaaactccttttgcccgggcggcaaaaggagtttttttattttcattgtgaatcctcgggaacaagcatagtgagatgatgtgttttcacttcgatcgtacaaggcgttgttccgtatacctcgccatctgtatccgcgtccatttcacgtccggtttcgatttcaatcctggaggcctgaatataggacagctctcctttgaaatcatcaaacgaaccctgctccatcgtcatcagctcccgcaacgcggcaaggcttgtgttgcggcagattaacacatcggctaagccgtcccggaggctcgcatcaggcaggggaattctgtttgtcccgatataatgcccgttcatgacaagcaccattacggcttcgtcttctttcacctcgccgtcaattgtcaatttgacaggaaacgggttcgcgcttgtcatcgtccgcaaggcgctcgtgaagtagctgattttaccaagccatgctttttcagtttcattgatatggctcgatgcttcggtgatcaatccgatgccccagaagttcagaaaatagccgtcatccgttttacagacgtcaatcatccgtttatgtccagccgcgagcgcttcagcggccttttgaaggttttgcgggatgccgagcgcccgtgagaaatcgttgcacgttcctcccggcaaaatgccgacagcgggcctgtgatcaagcttgctgatgctgttgatgcattgatgcacagtgccgtctccgcctaaaatatataaatggtcaactgaactgtcgaggttttcacaatactgacgggcatcatcctgatgtttggtcggtttaatcaaaagttcgtcagctgactgggccaaaatggggacgaccgtgccgagcgttttatcaatctgtttttgaccggcgtttccgttataaattaatactgctttccgttggctcatacgactgctcctttatttcagacaatctctttaacaagtttcccgtttttaaaaggtcataaacttacatcgggtacataaaaggaacaaaaaacaatttggatatgagcggtgtcatttgccgatagtgaggttccttgctatcataagaagagatgatcaaaaaggagaggtcccagttgaatatggattttaatttatttatgaatgatgtcgtgcgtcaagcccgccaggaaatcacggccgccgggtatacagagctgaaaaccgctgaggaagtggacgaagcgctttcgaaaaaaggaaccacactcgtcatggtcaactctgtgtgcggatgcgcaggcggtattgcacggcctgccgcgtaccattctgtacattacgataaacgcccggatcagcttgtgacggtatttgccggacaggataaagaagcgacagccaaagcgagagaatactttgaaggctatccgccgtcctctccgtcatttgccattttaaaagacgggaaaatcatgaaaatggtggaacgccatgaaattgaaggccatgagccgatggccgtcgtcacaaaactgcaggaagcatttgaagaatattgtgaagaagtataagtgaaagaaaaaccccggagccgagcgcttccggggtttttatatggaatctgtataaatataaatatttatacactggcgttctgctgtcactaatcgaaaaaacaatgactataataaacagagaaaggaaaatatatttttcaaaaatagtattgcatcacaattaaaaagtgtttaaaatacaagttaacgaataaatattcaattttaagagatcagtagatatgggggaaatgaatcatgaagaaatggctgttggtattagctgccgcatgtatcacctttgcgctgtccgcctgcggatcaggcaattcaggctcagagggcggaaagaacaagctgattatgggtacatcggctgactataaaccatttgaatataaggacggcgatcagatcaccgggtttgacgttgatctggcaaaagctctgggcaaaaagaccggctatgacgttgaggtgcaggacatggacttcaacagcctgattacagccttgaagtccaagcaggtagatatgattttatctggaatgacacctacgccggaacggaaaaagcaagttgatttttctgatatttattatactgctaacaatatgattgttacgaaaaagggaagcagcattaaatccctgaatgatctgaaaggcaaaaccgtcggtgttcagctcggctccattcaagaggaaaaaggcaagaagctcgcttcgaaatacggttttcagcttgaagaccgcaaccggatctcagacttaacggaagagattaaatccgggcgttttgatgccgcgattatcgaagacatcgtagcacaaggctatttcagttcaaataacgatctgcagggctttgcgtcagcagatgcgaaatcagacgaatcgggctccgcgattgcgttccgcaaagacagtgatctgacagcgaagtttaacaaagcgctgaaagaaatggagaaaaacggagaaatcgaaaaactgaagaaaaaatggttcaccaacgagaaataaaaggaagctcaacttttcgttgagctttttatcttgaataaagacaaaggagatcacacgtatgaatttggatttctcagcgacaattccccaaattccttttatattggaaggccttgcggtcacattaaaaattgtgctcgtttcagcggtcatcggtcttgtattaggaatcgtgctcagcttatttaaaatcagcacgatcagtccgctgaaatggattgcggatttttatacctcgatattccgcggcacgccgctcgtgctgcagctgatgatcatctatttcggtatgccgcagcttctcggctttcagattgatcaattttgggcggcggtcaccgcattatcgctcaattcagccgcttacgtctctgaaattatcagagcgggaatcaacgcaattgacaaaggacaaaaagaggctgccgtcgctctcggcgtgccgtacggaaaaatgatgaaagatctgctgctgccgcaggcgtttaaaaacatttctccggctattattaacgaattaatcaccttgacgaaagaatcggcaatcgtcacggtaatcggtctcggcgatattatgagacgggcctaccagtccggcgccgcaacatacaactatttagaacctcttattgtggcgggcttaatctattacgtgctcgttttgatcttagcattcatcggaaaaggcgtagaaaggaagctgaaagccaatgattaaggtcgacaacctgtcaaaatcattcgggaaacatgaagtactgaaaaacatttcaacacagatcgaagaaggggaagtcgtcgccgtcatcggcccttccggttccggcaaatcaacgtttctgcgctgcttaaatctgctggaaaccccgagcggcggaacgattgccattaaagaaaacgaaatcaccgcagctaaaacgaataaactgaaagtgcgggaaaatatcggcatggtatttcagcattttcatctgtttcctcataaaacggtgcttgaaaatatcacatacgcgccggtcagcgtgaagaaagagtctaaaaaggaggcggaggaaaaggcgtgcgctctccttgaaaaagtcgggctgcttgacaaacggaacgactatccgaaccgtttgtcaggcggacagaagcagcgggtcgccatcgcgcgggcgcttgccatgaatcctgacatcatgctgtttgatgaaccgacctcggctcttgacccggaaatggtcaaagaagttcttgaggtgatgaaagagctcgcgcagacgggcatgacaatggtgatcgtaacgcacgaaatgggatttgccaaagaagtcgcagaccgcgtattatttatggatgaagggacgatcgtggaagacggtcagccggaagaattttttctttctccgaagtcaaaaagagcacaggactttttagaaaaaatattataaaatataactgtgagaaaagaagaagaatgctcttcttcttttttttgagaaagaaacaaacagaatggagcaagcaatgtttaaaatcggttaccggacactaaagaccgcacttggaacggcgctggccatttatttagcccagctgttgcatctgcaaaacttcgcatccgcaggaatcatcaccatattgtgcatccagattacacaaaagcggtcgcttcaggcctcgtgggcccgatttgccgcatgtttattggcgatcgtcttttcatatgtctttttcggactgatcggctattatccgtttgcgatcggaatattgctggtgctgttcattccgactacagtcgttttaaaaataaatgaagggatcgtcaccagctcagtaatcattcttcatttatatatgtccggcggcattacgatggcgtttatctggaatgagttccagctgatcaccgtaggtatcggcgtcgcgctgttaatgaatctgtatatgccgagcctcgacagaaaactcgcagcgtacaggaaaaaaatcgaggacaacttttccgtcatcttcgccgaaatcgaacggtatttgttaactggtgagcaagattggacggggaaggaaataccggagacgcatcagatgattcaagaggcgaaaaacctcgcctatcgggacgtgcagaatcatattttgcgccatgaaaatctctactatcattattttaagatgaggcagaaacaatttgaaatcattgaacggctgctgccgaagattacctctatttcaataacggtggagcagggaaaaataatcgcccatttcatccatgaattaagggaagccattcatcccggcaataccgctcataaatttttaaaaagacttgcagaaatgagaacggaatttgaagaaatgccgctcccggcaacgcgtgaggagtttgaagcgcgggcggctttgttccacctcctcggtgagatggaacaatatctcgtgattaaaagttatttcaaaggcatcaagctgtaaaaaacatatggatcaatcgcatgagtcctcctttcattggtcattctaatgaaaaaaggaggggagcccatgcgattttttttattgtcagccgtcctgctgctgtctccgctttggccgcttggcgcgaaccctttgccgggtgacccttatattatcgtcaataaagccacaaatgcgcttgctgttgtaaaggataaccgaatagaaggcatttatcaggtggcgacgggaaaaacggatgatttgacgcctgaaggagaatttacggtaacggtcaaagccgtcaatccgtattaccggaagaaaaatgtagagggaggcgcgccggaaaacccgctcggcgtccgctggatcggttttgatgcgaaaggcaccgacggcagaatatacggcattcacggaacaaacagagaagagctgatcggggggtttgtatcaaacggctgcatccgtatgaaaaaccgggatgtcatccgtattttccggattatccctcccggaacgaaagtattgattacaaaagaaaaccgctcattcgaggacattgcaatagagcggaaagccctcataaaaaagcaggaaacccccttgcaatgaggcgcctgcttttttactgcaaatacatcataatgcctgagaggagggttgaaagtataaatacgcccaaaatgacgatgacggcgcttttcataaatttttgagacattgtttcactccttaagattactgtctaccattttaacgtgttttgcttatatgaacaagccatatcctatgggggaaagcaggtggccgcgctatgaaaaaacttgatcatgtcggcattgccgtcagctctattgaagccgcgagaggattttacgaacagatgctcgggcttacgtatatgggagacgagctggtaaacggccaaaatgtgagagttgcttttttagaagcgggaggcacaaagcttgagctgattgagccgctgtcggacgcgtctcccgtcagctcttttttacagaaaagaggcgaagggctgcatcatttggcattccgctgcgccgatatgaaggaaacgatcaaggagcttgaatcatgccgcatgaccttgcttcatcatgaaccgcaaaacggagcgggcgggaagaagatcgcatttctctctccaaaagaggcgaacggcgtcctgattgagctttgtgaaacaattgaaaaaggagaaactcaagatgaacatgagtgatcatatcagacacttaaacgaaagacgttcctttttaacaaacggcggcggagcggaaaaaaataaaaaacagcacaaaaaaggcaagctgacggcaagagaaagaattgactatctattggacgaagacagtttttcagagctgcagccgtttgccaaaagccgcacgcccgggtgccagaatgctccgggagacggcgttgttaccggatacggcacaattgacggacggcccgtgtatttgtttgcccatgactttaccgtactcggcgggacgctcggcgagacgcatgcggaaaaaatcgcggcggtaatggatctggcggcgaaaaacaaaaacccgatcatcgggctgaacgactcaggtggtgcgagaattcaagagggtgtggtatcattaaatggatacggtcatatctttaggcgcaacgtcctttactcgggagtgattccgcaaatttctgtcattcttgggccgtgtgccggcggtgctgtttattcacccgctttgacggattttgtgattatggcggaacatacgtcgcacatgtttattacaggcccgaaagtcattgaacaggtgacgggtgaacagattgacgcggaaagtttaggcggtgcgggaatacataatgtgataagcggaaatgcccactattccgcacgaacggaaaaagaggcactttcggctgtgaaaaccctgctttcttatctcccgcacggcggacagacggcgctacccgttaaaaaggaagacgccagaccgttattaaacaccctcgttcccgcggacagttcgaaaccttacgatgtgttacaggtaataaaagagctggcggatgacggaacgttttttgacattcagccgtattttgccaaaaacattgctgtcggttttctgaaactcggacggcgtacagtcggtgttgtcgcaaaccagccgaaacacttggcggggagcctcacgattgatgccgctgacaaagcgtcgagattcatccgtttttgcgacgcgtttcatattccgctattgacgatcgctgatgttccgggatttcttccgggccttcagcaggaacatgcgggaatcatccgtcacggagcaaaattgctgtatgcttttgccgaagcggcggtgccgaaagtgacgctcatcatcagaaaagcttacggaggcgcttatgtcgccatgaattcgaaagggctcggagcagatcttgtattcgcctggcccaatgcggaaatcgccgtgatgggagcggaaggcgcggcgtcgattttatacagcagagacatacaggcttctggggacccggagaaaacgaagcgcgaaaaaaaagccatatacgaaaaggaaaacgccggtccgtataaagcggctgcctgcggtatggtggatgatatcatccggccggaagactcgaggaaaaaattgattcaggcatttgacatgcttgcgcataaggaagaggaaagaccgaaaaaaaagcacggtaatataccgctttaaacggagggaactgaaaatggtaaacgaaaaacgtctgcttgaagaatttcttgaactcgttcaaattgattcagagacaaaacatgaagcggaaatcagcaaggtgctcaaacaaaaattcactgatttaggattgagcgtaaaagaagatgatacaaaagaagtgacggggcatggagccggcaacttaatctgtacgttaaagggcacaaaagatgcggatacgatttattttacatcccacatggacacggttgttccgggcaaaggcgttaagccgattgtggaagacggctatgtaaaatccgacggcacgacgattctcggcgctgatgataagacgggtcttgccgcaatgtttgaagccattaaagtgctgaaagaacaaaacatcgagcacggcaccattgaattcattatcacggccggagaagaatcgggattagtcggggcaaaagcaatggatcgttcagacattaccgcgaaatacggttttgcgcttgattcagacggaaaagtcggcaacattattgtagccgcgccgacacaagcgaaagtgagagcaaccattttcgggaaaacggctcatgcgggagtagaaccggaaaaaggcatctccgcgattacaatcgcatcaaaagcaatctctaaaatgccgctcggccgtattgataaagaaacaacggctaatatcggccgtttcgaaggcggcacgcaaaccaatatcgtctgcgaccaggttgatattctggctgaagcgcgttcattagtgcctgaaaaaatggaagcgcaagtgcagaaaatgaaagaagctttcgaatctgctgcagctgagatgggaggccgcgcggaagtggacatcgcggtcatgtatccgggtttcaaatatcaggacggcgatcaggttgtggaagtcgcgaaaaaagcggcggcaaaaatcggccgtccgagcgaacttcagacaagcggcggcggaagtgacgcaaacgtcattgccggccacggcattccgacagtcaacctgtcagtaggctatgaacaaatccatacgaaaaatgaaaaaatgccgattgaagagctcgtcaaaacggcagaaatggtcgttgccattatcgaaacagcggccaactaaaaacgaagcacccagttgattgggtgcttttttcattcttcataatattaggcttaaagctttgcagatacaagaaaaaaccctgccggataggttccggcagggtttcagtattatgatttggcgggctccgcctgagccgcagcctgtttctttttatgatgcgtctgctgtaaaagtacgttctgcactgtcaaaaacagtccgcttgtaaaccagtaaagcggcagcgcagccggtacgttaagcgaaaaaacggtcatcatgacagggaaaataaagaccatgatttttgctgactgcatcgcggccggattttgagcagccggtgaatatttctcgtttaatttttgggaaatataagcctgtaagaaatacatggcccccgcgcacagtgatacaagaatatcagaatgccctaagctgaaccacagaaatgagtgtgaagcaatttccggcgttgagcggatggcgtaataaaaaccgatcaaaatcgggaattgcaccagcatcggaagacatcccattgccatcggattcagattgtgctcacggtaaagcttcatcatttccatttgcagttctttttgtttttccgcatctttcgtttgtttcattttagcctgaatgctgtcgacctgcggtttgatcacagccattttttcctggaacacccgctgtttcttaaattggttcacaaacaaaggcaatacaacgatccgaacgataatcgtcaccagaataatcgacagtccgtactcaccgtggaacaggcccgccacaccttttaaaagtgccgaaaacggctcgatcaggtaatcgtggaaaaaaccgatattcccgaggcctcccgtctgagtctgagatgtcgccgcaaaagccgagcggcctgtgcacaatacgataaaaaacaatcccaatgcgatccatttttgatatgttttagacaattatgtttcctcctttatatcttcacttgccgttataaaaggaggaagctgacatcttcatcatcattcgccggtgaattcatgcggatgactttacgtatccaagttgtaatgcgatgatatataataataagaaagtctgttcggttcagctgaacgactgcttgatgttcatctattcgtttcgttctccaatgctcgcctgcgcggcgctcacgcaaaagaaaagcgatgccgatcgcggtcagagctggaagaataattgtgaaaaaatcgactaaaaataaaaagtcattcattgactcaagaatcattttatcacatccattcagctcttattttactacatatatataaggttgtctatgaaaggaaaggaggcgccgggagtggccggaaaagggagaattatatttcatatcgatatgaacagtttttatgcctccgtagaaatggcgtatgatccgtctttaagaggaaaacctatcgccgttgccggaaacgtgaaggaacggaaaggaatcatcgtcacctgcagctacgaagcgagagcgcggggcgtaaagaccaccatgccggtgtggcgggcaaaacgcctctgtccggaactcatcgtcgtgcctccgaattttgaccgctaccggagttcgtcaaaagaaatgttcagcattctgagggagtatacggatttagtcgagcctgtttctattgatgaaggatacatggatattacggacacaccgcacagacacagggcgtatgagacagccgcagacattcaggcgagactgcaaaaagagcttttgctcccgtcaagcatcggcatcgccccgaataaatttctcgctaaaatggcgtctgacatgaaaaaaccgctcggcatcaccattttaagaaaaagagagctgccggacgtcttatggcctcttccgatagaagagatgcacggtataggaacgaaaactgcggaaaaaataaaaacgctcggcatcaaaacgatcggtgatttggcaaaaggagatgaacatgcgctgaaaacgcttctcggcataaacggcccgaggctgaaggataaagcgaacggcatccatcctgcagaagtcaatcccgagcggatttatgaatttaaaagcgtcggcaactcatccaccctgtcgcatgattcggctgactgggatgaattaacaggcgtgtttgaccggcttgcgctgtctgtgagcgaacggctccagcgtaaggaggtcatggcctgccggctgttcatcatgattcggtatgcggattggaaaacagtcacaagaagcatgaccctcagcaatccggctgatcagaaaaaagacatcatggaagcggcgatggaactgtttgacaagcactggaaccaaaacccggtaaggcttctcggcatcaccgggacggaactggttgaaaaacagcaggcgtataaacagcttgatctgttttcattcaaggaggacgcaaaggatgagccgatttttcagatgatgaacgagctgaatgaaaagtacggccaaaatctgatcagaaaaggcgccgttataaaaaaagaagaaagcaaaacaaggggaacaagctttaacagagacttttttcaggatgaaaagaaaaggtgaataacttgaaaaaaggggttatgtatgataatttctttagtataaatatcattttattttaatttaaattttaaaatggttaaacgtttgaagaagggacgttagaatatgtcaaaacaacaaatcggagttatcggtcttgcggtaatgggtaaaaatctggctcttaacatcgaaagccggggattttctgtgtctgtatacaacagatcaagcagcaaaacggaagagtttttagaagaggcaaaaggtaaaaatgttgtcgggacatacagcattgaggagtttgtccagtctcttgaaacaccccgtaaaattttattaatggttaaagcgggaactgcaacggatgcgacgattcaatctcttcttcctcatctggaaaaagacgatattttgattgacggcggaaatacatactataaagatacacagcgccggaacaaagagcttgccgaaagcggcattcactttatcggaacgggtgtatcaggcggtgaagagggagcgctgaaagggccttctattatgccgggcggccaaaaggaagcgcacgaactcgtaaaaccgattttagaagccatttctgctaaagtggacggagaagcttgtacgacatacatcggcccggacggagcggggcactatgtgaaaatggtgcacaacggtatcgaatacggtgatatgcagctgatctctgagtcatatttcattctgaaacaggtgctcggattgtctgccgaagagcttcacgaagtattcgctgagtggaacaaaggagagcttgacagctatctgatcgaaatcacggctgatattttcactaaaaaagatgaagaaacgggcaaaccgcttgttgacgtcatccttgataaagcgggccaaaaaggaacgggtaaatggacaagccaaagcgctcttgacttaggcgtgccgcttccgattatcactgaatctgtttttgcgcgtttcatttccgcaatgaaagaagagcgtgtgaaagcaagcggccttctgtccggaccagacgttaagccggtcactgaaaataaagaagagctgattgaagcggtcagaaaagcgctcttcatgagtaaaatctgttcttacgcacaaggcttcgcccaaatgaaagccgcgtctgaagaatataactgggatctgaaatacggtgaaatcgcgatgatcttccgcggcggctgtatcatccgcgcggcgttcctgcaaaagatcaaagacgcatatgaccgtgaaccggagcttgacaacctgctgttagacagctacttcaaaaacattgcagaaagctaccaaggcgctcttcgccaagtgatttcacttgccgtagcccaaggcgtgccggtaccttcgttctcaagcgcacttgcatattacgacagctaccgtacggcagtgcttcctgcaaacttgattcaagcgcagcgtgattacttcggcgcgcatacgtatgaacgcacagataaagaaggcattttccatactgaatggatgaagtaatgaagaagcccccgcattgattgcgggggcttttctgatattaaaaaccgcgggccgtcatgaacggcgccgcggtttttaaattttttcttatatattccaccagtggagaccgtctttttcaagaagatcgtccgaagctttcggtcccattgaccctgcttcataattcggagaaagggttttgtcggctgcccacgtttcggaaatcgcatcgacgaaattccaggaaagcgccacttcgtcccaatgggcaaagtttgtcgcatcaccgagcagacagtcatggattaatttttcataggcttccggtgtgttcatttcatcactgcagttgctgcagtagtccagcttaatcggctgagcatgagcggctccgcctaattttttagcgttcagatatagtgtgatgccttcatccggctgaatatggatgacaagcaggttcggatttacattcgtttcattgccgtaataaaggttcatcggaatgtctttaaattgaacgacgattttcgttgatttttctttcatccgtttccctgtgcggatataaaacggaacgccggcccagcggaagttatcgattaacagctttccggacacgaatgtttccgtattggaatccggtgctacattatgctcatctgtatagcttggtacagagtttccgtcaatcgttcccgcttggtattgtccgcggacgaagtagtcactcacttcgtttggagcgacagggcggagagctctcagcaccttcactttttcgctgcggatttcttccgtgttcagtttaatcggcggttccatcgccaagagagcgaccatttgcaaaatatggttttggaccatatcacggagtgcgcctgatttttcataatatctcgcgcggtcttcaacgccgagatcctcacttgacgtaatctggatgtttgagatgtagcggttattccacagcggctcaaacagcgcattcgcaaaccggatgacttcgatattttgaaccatttgtttgcctaagtaatggtcgatccggtaaatttgatcttccgtgaaagcttcgcgtatttctttgttaagctctttcgcactcggcaggtcatggccgaacggtttttcaatgacgagacgggaccagccatttgtcgctgtgacaccttcgtttttaagtgattttgcgatcgtgccgaaaaactcaggagccatcgccaagtaaaacattctgttgttcgggatttcatatgtatgttcaagctgatcaagcaggacattcagctcctgataggaacccggattcgttacatcaaacggatggtaataaaaatgagatgtgaaatcgtctatgtctttttgcccggcagaagaaacagacgttttaaccgtttcccggaggtcctcgtttgaccaaggtcttcttccaacacctacaactgcaaactcttcaccaatttgaccatttttatataaacggtgaatggatgggtaaagttttcgttttgccaaatcccctgtggcaccaaatattacaattactgcttttggtttgtcgtttgttttcacttagagtacctcactttatctgaagcatggtttaaaaccccgcatatttccttcattttaaatctaaaattcattgaaagcaaacatttcagcctgttttttgcggtttgcggaaaaaaattaatcaggccggagaaggcccgggtgaattcacattttcagtctgatcctgtatccttagtagtacaaagatctaggaggaagcattgtggaattattatttttagggacgggggccggcatgccggcaaagacgagaaacgtaacgtccgtcgcgctgaagcttcttgaagaaaggcgttccgtatggctgtttgattgcggagaagccactcagcatcagatattacatacaacaatcaaaccgaggaaaatagaaaagattttcatcacccaccttcacggcgaccatgtttacggtcttccgggtctgttggggagccgttcatttcagggcggtgaagaagagctgacgatttacgggccaaaaggcattaaagcctttatcgaaacaagcctgaacgtgacggcgactcatctgacgtatcctcttaccgtacatgaaatcgaagaggggacggtttttgaagatgagcacttcattgttaccgcagcatccgtcattcacggtgtggaagcgttcggctaccgagttcaggaaaaggatattcccggcgcattgcaggccggcagattgaaagaaatgaatatcccgcccggacccgtctatcagaaactcaaaaaaggcgaaacggtcacacttgacgatggccgaatcattaacgggcgggattttctggaatccccgaaaaaagggagaatcgtcgctttttccggggatacgagggcatcagagcgggtaacggagcttgcgcgcaatgcggatgtgcttgttcatgaagcgacgtttgccaaggaagatgcaaagctcgcacataattattatcacgcgacgacagaacaggctgcgcaaacggcaaaaaaagcaggcgccaaacagctgatcttaactcatatcagcgcaaggtatcagggtgaatcgccgatagagcgtctcgaacatgaggcgaaagcggtatttgaaaacagtaagatcgcatttgacttcatggaggtcgctgtggagcggtcataaaaaatagacgcttgacatttttttctgatgagatataataaaacgtaataattacgatttaaaaaaggggtgaaaatgatgcgtgtgaatgttacactggcctgtacagagacaggggacagaaattatatcacgacgaagaacaaacggacgaatccggaccggttagaaatgaaaaagtattcaccccggttgaaaaagtatactttgcatcgtgagaccaaatagatcacgataacaaaagccattgtgccgttgcacaatggcttttgttttatcagtttaccgcctgataggcaggagcattcatttgctggcgcaccgcgcaccaaacatcataaatggcaaggtggacgatgtgcggttcatcgtgatgaatggcatgagaactgtttttggcctgaatccatccgctttgataagagacatcaagcatgcttctgtgcagtttcacccattgttcatgagcgtgctttaagcgctcatcccgctctcccgatgataaaatcaacagcggcatatcgccgaagtgaatctgctgatgcttgatctgcctaaggctcgtcaaaaattccgcgtgtgatccttccaatttgaactgtttcaaataggcggccttcatttcttcgggaagaagcggaagcactttcgtctcctgctcctcagaaaccggatcaagcagcaccatcccgagaatatcccggcggttccggctcgcccaaagtctgctgataatcgtgccgtatgaatgcgagacgacaaggtaaggaggcttgacaccggccttcagaagaagagcgtttaattcctgtaccatatggtccgccgttctcttgtttcggcttcgtccgcttttgccgattccggctctgtcatatgtgaaaaccccaaattcttcatctatgtcagcgagtaatgatgtccatgtttcagaagaagtgccgtagccggcttcaaagacgatcgtcacttcgccggcgcctttacggtgtttcgtataaaacggacacccgtcaatcagatatgtcctttccatccatgctgctttcattggagtcatctcctctaattggttctatagggaagacggagaagcttcggcaatcgtttctcgaaaaataaaaaaagagacagccggatcgaaaaaccccggctgtcacttcatcaccatgctctgtcgtattggaccggtgacggtatttcagtattcagctgcttcgctgcactccttgcaaagtgcggatcgcggagaagttctcgcgcgacaaaaataaggtcagcgcggttgttttgcagaatttcttcggccattgttcccgtcgttatcaaaccgacggcgcctgttgcgatttcggcctgttcacggattttctccgcgaagctcacttggtagccggggaagacgttaatatcagcttgaacgagtgcgcctgagctgcaatcaatgaggtcgactccctgttctttcatccacttcgcaaaaccgatatgatccgcaatgtccagccctttgtctgtataatccgatgcagaaatacggacaaataacgggccgtcccagacttccttgacggcttcaatggtctcgcctaagaagcggtagcgattttcatgtgagcctccgtattcgtctgtacggtgattggacagaggggacaaaaattcgtgcattaagtagccgtgtgcggcatgaagttcaatgatgtcaaagccggcttctttcgcgcgcgccgctgcctgtttgaattcctgaatggtttctttaatttgttctgtcgtcatttcagccggtgttttggactgctcatcgaacggaatggctgacggagcgtaaatgtctccctcaagctcagctttacgtccggcgtgcgcaagctgaatgccgattttagatccttgcgctttcacttgttccgtcagtttggcaaaaccttcgatatgatcatcgctccagatgcccaaatcctgatcggaaatgcgcccctgaggattaacggctgtcgcttccacgataatcaggccgacctgtccgattgcacgcgatatgtagtgcgccatatgaaaaggctgcagttttccgtccttctcatgtgaggaatacatacacatcggtgccataacaatacggtttttgatcgttacatctttaacggtccatggtgtgaataattttcttgccatttatttcgcctcccggaatgtttttagacattgattataacaactcatgatcattcagtcatataaactgctcacaactgaacagatcgttcttattgttctggacgggcatttttttatacacagcgtggccgtatcttcataacaggcatttacagccgatcatatagcaaatatagatgagaaacgcaccgatgactgcgtggcctcctttgatccagtttgtcaggatgaaaatactgctgatgaagatcactgcgccgaaggcaccgaatattccgtttttttgagcggctctgaaatcgtcggggctcatatttttcagctgcaagtgaatattcagtaacgacatgatcggcagcaatgtgataacgcctgataaaaataagtatttcgacttgcttaaatacgcggcggccaccataacggtgccgccgataaaaaattgaatgagaaaactcatgctgaaacgctcaccttctgtttgttatcaagtataatgatggagacattgccattttatttttgattgatgtataagtaaactaaatataactaatgcattggataataaagaatgatatctgggagatgaagccgattggatttaaagaagcatttagcctttattaaaacggtagaaagcggcagcctgacccaagccgctgccatattgaattacacacagccgaacatcagccaaatgatcagtaaattagaggaagagtacggttttccgcttttgatcagacagcggcatggagtgaggcccaccgcaaatggcttgaaagtgttacatattatgaaggaaattcaaaaaaactatgaaaaactgtctcaaaccgttgataatattaatgggttagaaagaggggaagtccggctcggcactgttacgagcgtggcggtaaaatggctgccgaaaattttgagggaatttaatgagctgtatccttctattaaggtgcatttatttgatggaaattctactgagctggaacaatggctgaaagatgaccggattgatgcggcgattgggacatcccacagcgagaagtggcatttttacccgttggccgaggacccgattgtagcggtgatgagcccgcagcatgaattggcgcaatatgaaacggttccgttacatgtcatggagtccgtcaaatgtatcgtgccttatccggagacacattttgatgtgctgaaagtgttaaaggaagaaaagatcactccgcgggttgcttatcaaatcagaggggatgaagcgattattgcaatggtgcggaataatctggggatcagcatcttgccgcagcttttggtgaatgatggtgatgtgctcatcaaacggttcgaccggtatgtctccaggcagctcggcattttgacagctcgtgcaaaggagacgcagacaccttctgtccagaaactgattcaatgcatacaagaatgggttgcggtccatcaggcttctgcctgaagaagcctgatatgcgtttaagccggttcaggataatagaccagcaataaatatgtcatcggttccgaggaatgaaaataactgtgcggcatcgcccgaagtcagcacatgcttttcgtcatgaagctcaaccgtcaattcaccgctcttgattaaaatgattcccctaaatgtgattttgtctcataggcgcagcccggcttcaggtcaactatgccttgaaaacaaaaatttgaccgtgacggtggtgagcggggttattttgatgtcgggctttcgtctgtttatataaaaagggcatcaacggcacatgctgttgatgctttttttgaaatgctagggtttggagagcacttcaattccgacgttgaccattttgtccagccccataaaagacaggcagattttggcgcgtctttttcttttatcgatttttttaataatgccttccattcctttaagaggccctgaggcaacggttacttttgaattttcaatatagacttttgaataatctacagtgtctccttctccgatcagcctgataatagggaggatttcttcatccttaattgtcgtgaaataggttttgcgctctttggaataatatgctccgttattcacgattctgcatgaaatggggagttctttgattttatgaaatgtccgctctgtcatctttgttttaaacagaacatatcccggaaacatctttttgagtgcctcgtatttaattccggcttttcgttctgtgacttttttcttgggtatgattgagtagagagcctgctcatcaaactgcagacgcagaaatttttgaactgcttcttcttttcccgactctacaaaaagtgcgtaccatttcatgactggatcctccttagaataataagaaattattatacaaagaaagtatttaatggatagtatttaaagtgattaaaaatttttctaattcgtcttttttttacataatatatgaaaatgaaaaataagtatagacccaattgacagagaggcgatgaattttctttgacatgaaaagggttcagggaattatctgacatttatcccgaaacaattatgccgactgtccaccgaatataaaactgtggaataaatgtcagaaaataacgaaataaagccttgacattattatctataaattgatattattctctttaaatagcaactatttgttaaatttattaaattaaagtaaagcacctattaaatttcaatcgctgtttcggcacgttgaagaggaaatagggattataaaaatgttgcagtgtatatatctacatatacatgataagggagaagtgtgccgtcatggctgttttcgggcatattggcactgcagcttgtcatgcgaaacattcagtaaacaagcaagatgttttaatataaattatgttagaaaaggaaaacacaatgcgtttgcgatttttaaacctgtgctgaatcgcaaacgcgtttgtgtttttatttttatggcggtgtttacaccagtcaatatatgaaataagagacgtttttgtatggagaaccacatgtgatgtacaaaattggcgatggggaaaggatgaggataagatgcttacgtttgtgttcccggggcagggttctcaatttaaaggaatgggagccgggctgtttgatgaatttcaagatctgacacgtcaggctgatgacatattaggctactctatagaagaattgtgcctggaggatccgaatcatcagctggggaaaacgcaatttacccagccggcgttatatacggtaagtgcactcagttatttaaagaagattaaagagtccggcagagagcccgattacgccgcagggcacagtttaggagaatataatgcgttatttgcggccggctgctttgattttaagaccggtttgcagcttgtgaaaaaaagaggggagctcatgagcaaggcagctcccggaggcatggcggcggttttggggtttacggctgaacaagtaaaagaggttctatccgattatcatctgaccggcattgatatcgctaaccacaattcaccttcgcaaattgtgatcgccggaacgaaacaagacattgaaaaagcgggccccgcctttgaaaaagccggcgtgagaatgtatcttcctttaaatgtgagcggcgccttccattcccgctatatgaaagatgctgaaaaagagttcgcggattatttagaagaaacggcgtttttgcctcttcgttttccggtgatctcaaatcttcatgccgcaccttataagaatgatgaaatcaaaacaaatctgactttgcaaatgaccaatcaggtaaagtggacggacacgatacgccgtctgataggacttgaaaataatgaaattgcagaagtcgggcccggggaagtgctgacaaaactgacgcggcagattcaaaaagatgccgtcccattacctatgccgaaagaagagtctgatactgctgatgttaaagcatcggcagctcattcacaaaaaacggcgggaatgagattagggaacgaagattttaaaaaagattataacatccaatatgcttacatgacgggctccatgtacaggggaattgcttcggaacagatggtcattaaagcggcaaaagcgggaatgctgggctttttcggaacgggcggattgagtatcgaacggatcggacaggccatcggaaccatccggtctgcactgcggcaaggggaaacattcggaatgaatcttcttcatcatatgatgtcacctgacaaggaagtcagaatgatagatttatatttaaaaaacggcattcaccttattgaagcatcggcatttatgggcataaccccggctctcgtgatatacagggcaaagggattaagcaggaatcatgacggatcggtgtcagtccaaaacagaatcatcgcgaaagtatcccggcctgaagtcgctgaggcctttctgaatccggctccggctcatgtgctggaaagacttgtgtctgacaatcggctgacagccggggaagcggcgcttgcaaaagaaattccgatggctgatgacatttgcgttgaagcggattcaggagggcataccgaccaagggattccgtatacattaatgcctgccatgatcagactcagagaccgcatgatggagaagcacggttatgcgaaaaaagtaagaatcggcgcagcgggcggcatcggcactccggaagcggctgctgccgcgtttctgctcggcgccgaatttatcggaaccggttctattaatcaatgcacggtcgaagccgggacaagtgattcagtgaaagatctgcttcaggaagcgaacgtgcaggatacgtcatacgctcccgcgggagatatgtttgaagcgggagcaagggtgcaggtgctgaaaaaaggcctgtttttcccggcaagagccaataaactctttgacttgtacagacaatacaattctttagatgaaatagatgaaaaaacgaaaacattaattgaagataagtatttccagcgcagttttgaggaagtgtatgagcagttgaaacgtgataaatctcctgaacagatcgccaaagccgaacagaatccgaaacacaaaatggcgatggtatttaaatggtatttttcccatacgacgaggctcgctctggaaggaaaaagcgaaagtaaaatagattaccaaattcattgcggccctgcgctcggcgcgtttaatcaatgggtgaaaggaacccctcttgaaaattggagaaacaggcatgtcgacttgatcggcaaacagctcatggaagaaacagccggccttcttgcgcaaaggctggtatcgattacaggctgagtatgaccagacattacattttttctgcggaggactaccatgctgattgaaaatcatgaattaacgatgagccatgtcggattagggaatttgaatgagtacgcgctgctgctgttattcggcaatgcacacagtcaccatttaacggacggaacgggattccggcctgatcagatggccgatcatcaagggctgattttgtatccggcttattttatgacacatctcaaagttccttcagataagcctcttgatcagtaccgattatgggacgaggtttccgtcggagtcgatatctcccggtttggagaaaccatattagaatctgattatttgttcgggccgaaaggagcggtcagctctgataaaagcgagtgggaccggggacggtttccttctatgaaagccaatagtttaattgtcgttgacgtcacacaaacagaaggttcgacgcgcaaagtctcagcgccgaaggctgaatgtattgcggaactttctaagctagccaagccgccttacgcgctgatgcggtcaaagaaagtcagaacggacgctttcggtatgaagccgggaaacctcaaaacagcggaccccgtttcatatcgggttcctgttgatcaggatgctgcgccggggcatgccatggtgtttgcgaaattcagcaagataatggatgcggcggaatttgaatggatgacgcgccggtcgaagccgggttttccggtttcaatcgcgcggcatttatttttgcttgaaagagagacgtattattacggaaattgttttgcagatgaagagcttgatatttatatgacgggacacattgaagaatgcgatcccgactttcacggtgagtccctcggtatgatctcagtggcgaaaatcagctatcagattgaagtctatatgaaaaggaatcatacattgctggccatttccaaggtggataagctgctggcggtgccgacctcttcacaagatcatattccggattataaacgggtcatcagaagtttataaaatgaagaatggagctgaaagcaaatggaacaaaccaaggaaatgaagcagatcatcgctcaaattattcaggatattcaagaacagcagtcatatcgggccgtcgaagcgggagatgatgtgagagtcatagaggatctgggcttctcatcactggatatcgctcaattagtcgcacagatggagatggaaaccggagtggatcctttttcccaaggagaaacgatttccagcattacaaccgtcggcagcatttgtgatatttatcaaaaatacatggacagtgctcaatcatgaaaacagaaagcaggggagatatcagctgggtgactgataagcttagggaaacgcaggacagtgagtttctcatttttaaagggcagacttttacgtatgatgatttgctgacacgaatcagcttttttcagaaagaacttgaacaaaacggaatacgtgaaggagaatgtgtggcgcttatcggggattattccccgaacgccatttttttgctgatggcgcttttgttaaaccgaaatatcgttgtccctctcagcaatgaatcaagggaaaagcatctcgatatgtttgaagacgcgaaagtgaatcaaatcattgaaataaatgaaaatgacagctggacgcttcgtgaaggttctgaaagcgcctctcaccctctgcttgatgacctgcgcgagaaaggggagtcaggcattattattttcacatcgggaacctccggcaaaagcaaagcatccgtgttaagcgccggccggctgcttgaaaaatacaaaacggcgaagagaaaaccgctgcgtacgctcatttttctgaaattggatcatataggcggcattaatacgctgtttgcgattctgtttaacgggggaacgatcgtcacatcagacagcagaacgccggagtccgtttatcaggcggtcgacaaacatgctgtccaagtgctccccgccaccccgacatttttaaacatgctgctgatgtccaaggcggatgccggctataacctgtcttcactccagctgatcacttacggcacagaaccgatgccccaatcaacgctgcgcggcattcaccggctgtttccggatgtacggctgaaacaaacatacggattaactgaactgggtatattctcaacgaaatcaaaagacagccaatccacttggatgaaagtaggcggtgccggaacagagaccaaaattaccggaggcacgctttgggtccgttctgagtcggcgatgctcggctatttaaacgcaccgtcacccttcgatgaggacggctggtacgacaccggtgaccaggtggaaacagacggcgaatatataagaattctcggaagaaagagtgaaatcattaatgtgggcggagagaaagtgtttccggcagaggtggaaagcgtctttctggagatacctaatgtccgggatgttctcataacgggccgaaaaaatccgattacaggcgagattgtcgcggcagaggccgtacttgaaaaagaggaagatatcaaatctttcagaaagcgggccgtagctcattgcagacagaagctgcagccatatcagataccgcagatcatctctgttacagatcggaaactgtctaatgaccgatttaaaaaaataagaaacgtgtaaaacaggaggcaaatatgaataacggaaaagtagcggtcgtcagcggaggtagccgggggctcggaaaagcgattgtacaggcgcttttggatgagaattacaaagtagccgctttcagccgcagtgaatctgattttattaacacattgagagagagtgaaaagtaccgtgaccgcttttattgggaagcggcggatgcggcggatgatgccgccatgaaacagtttgttcttcaagtgtaccgcaagttttccagaatagacggcttggtcaataacgccggtttgaaccttgatcagctgctgcccctgaccaatgatgaagacattgatcgcatcctcaatctgaatatcggttcagtcatcaagctgacccgaaacgtttcccgggtcatgctgaaacaaaattccggatcaatcgttaacataagctccattatcggttcaagaggatttaaaggcacttcagtctacagcgcatccaaagcggctcttgacggcttgacgcgaagcctggccagggagctcgggtccaaaggaatccgtgtcaattcacttgcgcccggttttgtggacaccgatatgacgaaaaatatgccggaaaaacaaaaatcgcagattatcagaaggacgccgatggggcgtttaggcgaaacagacgatatgaccggactcgttcgttttctgctttctcctgaatcgtcctttatgaccggacagacaatggcaatagacggcggattaacttgttaaagcacagaaaaattcttttgtacaagggatggtatcctcatgaaatgtattaacgaatttttaagaacggtaatagcggaaaagctgggtgccgaggtgaccgaagcagaagataaaaccgctttttttactcttggcgtgacgtctctcatcagtgaagaaatcatgaccatattgcataaagaatttaccggcctttctgaaacgctgctgtttgaatatccgaacattgagaaattgagtgagtttttaagtgcgcagaaacgaaatcccgaaagcgttcttgaattcaaagaaacggagcctgatacgggaagccggcaggaagaagaagtgcttcctgtacaggcggctgaaaaggtgcctgaaccgggaacggacaggagttctgatattgcggttatcggaatgagcgggatgtttccgaaagcggaaaaccagcatgatttttgggacaatttaatggaaaataaagattgtgtctccgaaatccctgaggacagatgggacagctcttattactcggaagagaaaacggcagaatacgcgtcatacagtaaatggggaggttttattgatcgtccggatcgatttgacccgctgtttttttctgtttccccgtgggaagctgatttaatggaccctcagcaaaaattgtatgttacgtgctgctgggaagcgatggaggatgccggttacgggaacccggcggcgaggccgacggatcaaatcggtgtattcgccggagtgacctggaatgaatattcattaattgcacacgaagaaggtttcctcaaagatcagtataaaggccccggctccttatattggggcattccgaaccgggtttcttattttcttgatctccatgggccgagcatcgctgttgatacggcgtgttcttcatcgcttgtcgccgtccatcaggcttgtcaggccattatgtcgggcgactgtgaaatggcgcttgccggaggcgtcaacctcagcttacacccgcaaaaatacatgtttttaagccaatcgcattttctgtcttctgaaggaaaatgccgcagcttcggtgaaggcggagacggttacgtgcccggtgaaggcgcgggagccgttttgttaaaaccattgaaaaaagcgattgcggacaacgaccacatctacggtgtcattaaggggtccgccactaatcacggcggcaaaacgaccgggtatacggtgccgaatccggaagcgcaccgggacctgattttatccgctataaacagagccgcggtaagtccggcggatatcagctacattgaagctcacggtaccggcacggcactcggcgatccgattgagatacgcggtctgtctatggcatttgagaaacagaccgatgagaaaaatgactgcggaatcggctcggtgaaatccaatatcggacatttggaagcggctgcagggatcgccggtttaatcaaggtgcttttaagcatgaaacatgaaacgcttcccgccagtctgcacgccgaggaactgaaccgcaagatttctttttctgattcgccattttatgtcgtccgaaacaatcggccgtggccggctgaaggagataaaccgagaatcgccgcaatcagttcattcggcgcaggaggctctaatgcccatctgatcgtaggtgcttatcagccaaaacggcaagcggacgggaatactgagcaaaaaccgcatgccgtcgtactaagcgcacattccgaacagcagctgaaagaatatgccggaaaattgagctcctttcttgcccgattggaaaactcgccttctgccggcggatacagcctggaaaatatcgctgccaccctattgtcaggcagagagcctttctccttccggcttgctgtcattgcgtcatcccttcccgagctgaaacagcgattggacggttttgtgagcggtcacagcggcggcaggcatatttacttcggaaaagcgtcacccggacggccggacgtttcaggccaatccgtttcagatcctgaaaaatttgccgcgctgtgggtcaaaggccttcaaggtttcaaaaagccggagacgccgtatcagaaagttccgcttcctacgtatccgtttttaaaggaaacgtcctggctgaccgaccaaaaaaagcggtatacgaaaaagccccaatctatcaaaaggcgtgaagcgctgcatccgctgcttgatgagaatgtttcatccgcccggaaagggacgtttcaaaagatattttccaaggatgaatatttctttaaagatcatttagtgaacgaaaaatatgtgctccccggagtctgtcatcttgaaatggcggcatacggcgcggcattgtggggagaacgcccggtcgtctctcttcaaaatgtgtggtatatggagccgattgtgacagggacagacgcaagatccgtcatgatagagtttgaagcggaaaaagagcgtataagctatgtcattaaggaaaaaggagcggacggcactctcttttcgcaaggagaagtgatttgtaaagaaaatggagcgtcgtttgaggccccggtctttcagcttccggcgccatttacgcagagaacggagccgaaagacatctatcactcgttctctgaggcgggaatcgtgcaaaaggacagttttcaggtcatccgcgaattctcttatacagaaaggaaagcactggccaaattaacgctcccgtcacacttggaagcggattttaaacagtacatcctgcatccgtccttactggatggcgctgttcaaactgcaatggcgcatgtgctgcaatttcaaaaagagcctgcgcttatcgtaccgttttccttcggagaaatacagctgcttaaaccgttagcgaaaaccgtatttgtgcatgcggaggtaaaagcggcctccgttcaccaatttgatctgcatatttgtgatgagcgcggtgtgctgctggcggcagtgaaagattttatcataaaagaggtgcgggaaagcgccgggtttaaccaaaaagccggcgtcatgccgaagaaaagccgtgaaacggaattgcttatgacaccggtttggaacaccgtcaccattccggaaaccggcatgtctttcatgcgtgaagaaaaaataatcgtcatcgggggcgggccggattttcagcaggctttgaaagagatgtattccgatgtccgttttccggacatcacttctttggacagcgcggaacaaatggctgaaacactgaaagcgcaaggctcttttcaacacatgatatgggcggcgccggatcatccgattccatccgtttatgatgcggatacggccgacggacaggagcacggggtcatgcagcttttccggctggtaaaatcgcttctgcttctgaattttgacacggaacaactatcattgacaatctgcacgtttcaagcacagccgattcatgaacatgatgaggtcaatccgagtcatgcaagcatacacggattagcgggggcgctcgcaaaagaatacagcaattggagcatccggcttcttgatttgaaatctcaaaggggagaccggcatcttcccgatatcttctctttaccggcggaccccgagggaaatccgtgggtctttcgtgcaggtcagtggcaccgccagcaattggccgtctgccagcctcatgcaggtgagccttcattataccggcacggcggggtttatgtgattatcggcggagcaggcggaataggagaagtatggactgaatatatgattcagacctatcaggcgaaaattgtctggatcgggagacggaaaaaagatacacagattgaaagaaagctgaaaagacttgcggctttaggtcccgcaccgcaatatttcagcgcggatgctgcggattatgattctctcaagcgggcgtatgacaccattgtgaaggaacatggaaaggtgcgcggaatcattcattccgccatcgtgttatcagaccggagttttgccaatatggaagaggaccagttccgcgcttcactttctgcaaaaactgatgtcagcttgcagattgcccgggtagctgaaggggaaccgctggatttcttgctgtttttctcttcgatgatgtcgtttcaaaaagcgccgggacagagcaattatgccgccgggtgcacgtttaaagacgcttttgctaagcggatctcacaaaaagcgccgtatgccgtaaaggttgtcaattggggcttttggggaagtgtcggcgttgtcgcttcagaacaataccggaaacggatggagcgggacggaatcgcttctattgaggcgcccgaagcgatgaaaacgctggaaaccctgctttcgggaccttatgaccagctggcgctgatcaaaacgacagatccggtttttatgaaagatgatctgaaagaacaagtaacggtttatccggaaaagattccttccgcactcggacaattagcggttaacatcacgcagaatgacgaagctgagcgggtaaaagcatcaaatgtcatgagctgcatgagagagatggaatccctcattgaaaaaatacttgtatcaaccctttatgagatgggcgcaaggcttgatgagactttgccgttatttcaatcggctgccggcataacggaacaatacagcagatggctgaaagagagctttgtcttcctgactgaattagcgcttgctccggaaaaaacggatctaggggaggtgtgggaggaatgggagcggaaaaaagagacttggctgcgccggaaagacatgagggcgcatgtcagattggcagaagagacattgcgtgtgcttccagacattttaaccggtaagcttccggcaacggaagtgatgttccctgactcctccttccgtcttgtggaaggtatttaccgcaataatatcatttctgattttttcaatgacaagcttgctgacacattgattgcagttttgcgggagcgtctggaaaaagacccgcaggcgaaaatccgcattttagaaatcggagccggaacgggcgggacgagcgccgcggtcatgagaaaattgaaaccgtatgaagcgcatattgccgaatattgtttcacggatatttctaaagcatttcttttacatgcagaagacatattcggtccggaatatccttatgtcacttataaaatattcaacgctgagcagccggtatcaacagaagcgccggacatcggcacgtatgacgcagtgatcgcgaccaatgtgcttcatgcgacaaaaaatatccgctctgcgctgcgccatgcgaaagcaatgctgcaaaaaaacggccagctgtttataaatgagatcaacagccgcaccgtattcaaccatgtgacgttcggccttcttgaaggctggtggctgtatgaggatcatgatttacggattccgggctgtccgggggttgagccggccggctggtcggaagcgctttcacttgaagggttcgtccatcctctgtttccggctgaagccgcacacgacttaggccagcagattatagcggctgaaagtgacggaacggtcaggcttgccctcccgcaggcgtcagaagaaaaaccggagcgccgtccgtatgacgcagatggtctttcggatgatacattgcatttcagcttgagagaaaaaagcgttgaactgatgaagaaggtaatcggtgaagcgcttaaagtgccggcgcatcgtcttttatcccatgaacctttaaccgcatacggattggattccatactcgtcgtcagactgaccaacgcgttaaaagacgtcttcggttctgtcagcagcactttgttttttgaatatcaaaccattgatgagcttgctgattactttctgtcttcccgtaaagaagcgctcgagcggcaattcgggaatggacgggctcattccgaaaacgccggacggatgcaggctcccgcagaaagcgccgcgccgattccaaacgtaagggaacggggcatcacatatctgacggaattaataggaaaaacgctgaagattccgagcaggagaatggatccgtcggtttccttaaccgcatacggtttggattctattctggtcgtcaggctcacaaatgcttttcgtaacgtgtttgaccaaatgaccagcaccctcttttttgaatatcagacgatagaagaaatcgcggattacctgcttctttctcagcggggagcatttatgaaagcgatgggtgtgcgtgaggagcagctgtctgatcacacagataacctgaatgtaattcctcaaaacgaggaagaaagcaggacaaacggagatccctatattcaggatatcgctgtcatcggtctgtcaggccggtatccgggcgccgatcacgttgatgagctgtgggaaaatgtaaaagccggcaggcattctattacagaagtgccgaaagatcgctgggactggaaaacgttttataacgaggaacgcggaaaatgggggtccatttattcaaaatggggcggtttcctcgatgacattgataaatttgatccgctgtttttccgtatatctcccgcggaagctgaaaggatggacccgcaggaaaggttgtttctgcagactgcttattcaagcattgaagatgcggggtacaccccggccacgctttgtgacagccggaaaatcggagtctttgtcggtgtgatgaacagcaattacccgacagttcccagcgactggtctatcgcaaacagagtatcgtttttgttcaattttcaagggccgagtatggctgtggatacagcctgctcttcttctttaacagctgtccatctcgctgcagaaagcctgcggagcggaatgagtgaaacagcgattgccggcggagtcaatcttatcgttgatccggctcactatgagcggctgtccgctttttcaatgctgtctcccggtgataaatgcaaatctttcggagacagggcggacggttttgttgacggtgaaggagtaggggcgattgtgttaaagccgcttgctcaagcggagaaagacggcgatcatatttacggcgttatcaaaggaagcatgctgaacgcagcaggcaggacaaacgcttatatggtgccgaatccgaaagcgcagtttgatctgatcgcagagacgttgaaacggacagacattcacccgagaacggtcagttacttggaagcccacggaacgggcactgcgctcggtgatccgattgaaatcgacgggttaacgaaagcttttcgcctgacaacagaagaccggcagttttgttccatcggttcaattaaatcaaatatcggacatttagaaagcgctgccgggattgcgggaatcaccaaactgcttctccaattgaaacataagaggattgccccttcattgcatgcggcggaattgaatccgaatattgagtttgagcacactccgtttttcgtacagcaaaaagaaacggaatggaaacgacctgtcttgaatatcacgggtgaaatgaaggaatatccgagaattgccggtatttcctcttttggagcaggaggggcaaacgcgcatatcatcattcaggaatatgtgccgtctgacagcctgaaaccaagggaaaacgcgtctgtttctccgcaaaaaccggctgttattattttatcagcgcgaaatgagcagcaattgacagagcgcgcccgccagcttctggatgatgtcataagaaaaaaacgttctgacggggatttggccaaaatcgcttacacgcttcaggcgggaagagaaccgatggctgagcggcttgcatttacggccgagtcgatagaagaactgaaaatgaagcttatgagtttctcaaacgatcatatcgaacatgctcatatctggcggggcaggacagccaaacatcattcattggcggcttcgctcacttctgatgaagatatggcgcttaccataaatgcctggctgaaaaaagggaaatacggaaagctgcttgacctttgggttaaaggacttgacgtcgattggtcagctctttatcagcgcaacccgggccgcatcagtctcccggcttatccttttgccaaagaccgatattgggtcacaaaagctgatgtgtcacttgacaaaacaggctcagcggaaagtgagaaagcagccagacttcacccgctgctccatgcgaatacatcgacctttaccgcccagcgctttacttctgttttttcagggcgtgaaccgttttttgccgatcacatcgtcaatggaaaaccggtgcttccgggcgcggctgctttagaaatggcccgggccgccgttacacttgccgctgagggcttgccgggcgggaaagcgggtgtccggctcaaacagatcgtttggctccgtccggtgacggcgctttctgaaggcgtgacgcttcatgtaaaacttcagccggaaaaaaacggagacatcgcttttgaagcgtatgccgaaggagaagagccgcttgtctttttccagggaaaggccgtgctcgaagagacggagcgtgctcctgtactcgatgtggaggcggttcaggcgcgctgcggcggccggcgcatgtcaaaggctgagtgctatgaagcattcgacagtctcggcatcacctacggaccgtctcatcaggcgcttgacgccgtctatgccggaagcggagaagtgctcgcgaagctcactcttccgccgtccgcccgcgaagaaaaggagccgttcatcctgcatccgagcatgctggacgccgcccttcaggcttctatcggtctcgtgctctcagacggttccgcgtccggacggccgtttctgccgtttgccctccgggatatgcaggtgttttctgcgtgccgggagacgatgtgggcggtgctttcctcagcggacggcgcctatcatattgagctgtgtgatgaaaacggcgaggtatgcgtccgattgacggggctcaccgcccgttttctggaagaggaaacggagggaaaaccgctcttgcttcagccaaagtggcaggaatcaccgccgggtgaaggcggcggacaagcagagtctttcagatacgtgacgctgtatggcggaatgtacgctgaggacataaacggcgccgtatgtgcggctgacggcgaaggtccgattgaagaccgttatgacgcctgtgcggcggagctgtcagcgatcgtcaagcgtcttatcaaagaaaaacagaagggaaaaacgctgatccagcttcttgtccccgacaggggggaagacaatgtattggcggggctggccgctttcctgaaaacggctcaccttgaacatccgaagctgtacggccaagtcatccaagccgatccggacgagtcagcatcagcgcttcttgccaagctgaaagaaaaccgggcgcaccctgaacaagcggaaatccgttatgaagccggcaaacgtctcgtcagaaactggcgtcacctgcctgcgcctcaaagcggcaccgttccgtggaaagacgaaggggtctacctcctcaccgggggagcgggcggcatcggactgattttcgctgaagaaatagcctcccgcgtcaaaaacaccgtcctcgtattaacggggagggcggaagcgcttgatgaagagcgctccgcccgcttacggcgcttggaagcgacgggtgcgcgcgtactgtatcaaccggttgatgtgacagacaggacggcggtcatcgccctcgtccgcggcatacaggaggagcacggaacactcgacgggattattcacggcgcaggcgtgatcgccgacaactacattctgaaccagacagaaaacgaacggaagaccgtcatggcgccgaaagtgaaagggcttatcaatcttgatgaagcagcgaaagatgtgcggctggactttttcattctgttttcttccttggcgggaggcatgggaaatccggggcaggccggttatgcggcagccaacgcatttatggatgtttatgcagcccgccgaaatcgtctcgtgcgggacaacaagcggagcgggcagaccctgtccgtcaactggccgctttgggaagaaggcggtatgcgcgtggacaaagagacagaacggctgatgtatgaacagaccggaatgaaagccatgcgatcggcttcaggcatccaggcgctgtacgccgcttttgcctccggagcacaccaggtcatggtggcagaaggcgacgagaaacggattcgaaaaaacctgatgcctgaagcgccggaactgtcacgcagcattcatgtgtcaaggaagacccacgtccatctgccaaataaagtacaagcggaactcaaacatatgatatcaggcattctaaaggtgaaagaagaagaaatagatgctgaatcagagatgagagattatggatttgattcagtttcattcacgcagtttgcaaatgaactaaataaaatgtatgggcttgaactgacgccagccgtgttttttgaatatccgacagtctttagttttgcccaatacttgctgacggaacatccggatacattcggcccacaggaagaaacagaaacggagaaaccggttgagcgtaaaaaaatgaagacggaaccattctcgattctgtcccgccttcctaaaacaaaaaccgcagctgcacctgaagagcccgtggcgataatcggaatcagctgtgcatttccaatggctgaaaatccggaaatgttttgggagaatttagccggagaaaaggactgcatttctgaaataccgccggagcgctgggactggagacagtattacggaaacccgcagaaagataaaaatgcgagcaatgtaaagtggggcggcttcattgatgaaaccgctcaatttgatcctttatttttcggtatttctccgcatgaagccgaaatgatggatcctcagcaaagacttttaatgatgcatgtatggaaagcgattgaagatgccggctgctctgcaaaaagcctgtcaggtacaaatacaggcatttttgcaggcacgacaaacagcggttacgctcaggaagcttcaaagttccatatagagattgagggttcttccgctgccggaacggttccgtcaatcggtccgaaccgcatgagctattttctgaatatacatgggccgagcgaaccgattgaaaccgcctgttcaagctcattggtcgctgttcaccgtgcggtcagggcaattcaggccggagactgcggcatcgcgattgcaggaggcgtcaatgctattgtgtcgccggacatgcatatcagctttaataaagcaggaatgctcagtgaagacgggcgctgcaaaacattttccgatcaagcggacgggtatgtcagagctgaaggtgccggcatgattgttttgaaaacattatctgatgcggaacgtgacggcgaccgtatttatgccgttatccgcggaacggcggaaaatcatggcggaagggcggcttcccttacatcaccgaatccgaaagcgcagacagaagtcatgataaaagcgtatcagcaagcgaacatcgacccccgtacagtgagttatattgaagcccacggcacgggaacggcgctcggagatccgatagaaatcaacggactcaaagcggcttttgcagcgctttatcagaaagccggagtaacggcacccgatcagcctcattgcggcctcggttccgtcaaaacgaatatcggccacacagagcttgccgccggcatggccggacttttaaaaattattttgcagatgcagcacaaaacgctcgttaaaagtctgcattgtgaaaccgttaatccgtatatcagcctcgacggcagcccgttttatttcgtccgcgaaactcagccgtggaaagcggcgactgatgatagcggaaatgaactgccgcggagagcgggtgtcagctcgttcggatttggcggtgtcaatgctcatgtcgtgctcgaagaatatgtttctcctgttgaagagaaacaatggacggccggtgaacttcagccgtccttattcattctctcggcaaagacggcggaacagctgaaggaacgtgcggaacagctgcgcagatatttggaaaagtcacattcagctgacggagctcttgcggatatcgcttatacgcttcagcttggccgggatgaaatggaagagcgccttgccgtcattgctgaaacaaaagaagagcttacgaacgcgctgaatgatttcctcagcggcaaggagacggggcagaatttctttacaggccggaacaaagcgatgaaacagctgtttacagagatgacggacaatgcagaaatgagcggggccgtagatcaatggattgaagcaggaaagtatgcaatgcttgcaaaattatgggtgcaaggcttgcatgttgattggagtaaattgtatcaggacgaaagaccgaaaaaagtcagcctgcctgtctatccttttgcgaaaacacattgctggataccgcacagtgcgcagcatataaggcaccgggagacttacgggactgatacgtccccgcttgagacttatgaacgcctgcttgatgaattggagaaaaacgaaataagcatagaagccgctgtaaaaagaacgatcggtttttacagggattagcgtaatggaggaaaccatatgaaagagtttctgcaccgggttttttctgacgtcaaaaataaaaaaatgacaaaacaggatgcgatcggcattttgcgtgattatgatatgcggatgggacttcgccaagcggattcccttcatccgcttgctcagcagcatatttccgatgaaacgggacagggattctcggcagctttcagcggccgggaattttttctcgctgatatttctttacagcataaaaagcttatgcctggagaacttcttttggaaatggcgagagctgcggctgttttgacagtaaaggagactgcggctgtccggctgacgcatatcgtgtggtcaaagcccattctgactgaggctgagccgttccatatcgaaatcaggctgatacccgcagagggtgaagctaaaaggtttgagatttataatccattttctgctgattccagtcattatgatgtgtacagccaagggacgattcagccagttgatgctgcgcccggcatgctggatatcagccgcttgaaggaaaacagcggttccctgatggataagcagcaaattgaagccatcactcagaacgataccgttcaatacagtgagcacatgaaaggaattgagcgtatttacgcttcatcaggacggatgctggcagacatatcaattccattgacaaaccaaaaagaatccgcccgattcggcctccctccctgtgtgatgcaaagtgtgacagaggcatgcgcgctgcttggcggcaaagaatataaaacgctcgctccggtttcattggacgagcttttgttttatgaatcttgtcctgacaaggtatgggccgagatacaagagaaggcggggagcttttatattgatttatgtgacggagaaggaaaaatatgggcttctctgtcggggttgaagctgcagcctgtcatcaagacgggcgcttccggaaaaaccaatgccgaacaccgcagtgaacgtttgtatgaacaaacgcttcttcagctcaaaacgctttttggcctgactgcaaaaattgctgtttccaacatagatactgaagagccgctggaaacttacggaatcgactccgtcactgtgacgaaattgaaccgcgaattgtctctgcttttcggtgacctttccaaaacggttttttacgaatataagacactgggctctttggcagctcactttgtcacggattatccgaatgaatgccgaaaatggacaaatgatgatgagcaccgttcaggcatatcagaacaggttttggcaaatgaagattttccggtgcttccgtcgtttaccaagcgaagaaaacggcctgctttttccaatgagaaacagacaaaagaagggattgcgattatcggagtcagcggacgttatccgcaagctgaaacacttgaagagtactgggataacttagcggccggaaaagactgtgtgaccgaaattcccgaagagcgctgggaaaaggacaggtactacaacccagatcccgaagcggccgtgaaagcagggaaaagttacagtaagcggggcgggtttctgaaagatgccgctttctttgatccgctgttttttcaaatttcaccccgtgatgctttgaatatggacccgcaggagcgtctctttattgaaatgtgctggcaggtgctggaggatgccggttatacgaaggaacagcttgagaatctgtataacggccgggtcggcgtttttgctggcattacgaaaaacgggtacggaatgtactggaaaaacggcggcaccctgcagccgaaaacgtcgttcagttcagcggccaacagagtttcctattttcttaatctgaaagggccgagcatgccgatcgacacgatgtgctcgtcttcgctgactgcaattcatgaagcgtgtgaaaacatccttcgcggcgcatgtgacatggcgattgccggcggtgtgaatgtgtatacgcatccttcggcttatgcggagctcagcgcctatcgaatgctttcaaaagacggaacgtgcaaaagtttcggtgaaggcggggacggatttgttcccggtgaaggcgtcggggccgtgctgttaaagccgctgtcaaaagcgatggctgataaggaccatatttacggggtgattcgcggcactcatatcaatcacggcggcagaacaaacgggtatacagtgccgagtccgagcgcccaggctgacgtgatttccggcgcgcttgaaaaatcaggaatacatccgcggatgatcagctgtatcgaagcccacggcacgggcactgaactcggagatccgatcgaaattgacggtttgacccgcgcatttcaaacgaaaacgtcagataaaggcttttgcgccatcagctcagttaaatccaatatcgggcatttggaagccgcggcaggcattgccggtgtaacaaaactgctgctccagtttcaaaaacgaaagctggccccttcattacattgccgaagtttgaatccgaatattgcatttgaccggacgccgtttgcggtgcagcgtgaattggcagactggaaacggccggtcattgaggaaaacggagcgcaaaaagagattccgagaatcgcgggaatctcttcttttggcgcgggcggggcaaatgcccacatattgatagaagaatatattgaacctgatagggagatttctgagccattcacagatgaagatcccgcagtcattttattatccgccaaacaggaggccagcctgaagcagcgggcgcagcagcttcttcaagcgatcagaaaaaatgacgtcacagaccgcagcctccgggatgcggcttacacccttcaaaccggaagagaagcgatggaagaacgtgcggcgtttatcgtgacgtcgacagagcagttagcggaaaaactgcagcgttttattgacggcggaacagacggctgcttcaggggaaaaagcaaacagtataaagatattctagccgtttttaaggatgaagatatgcaggaagccgtccgtaaatggatgaaaagaaaaaaattcgcgaagcttctggaactttgggtaaaagggctgaagattgattggtcagagctttataacggcagcctgccgcatcgcgtcagccttcccggttatccatttataaaggatcgttattggccggacgatgcagcgccggacaatgttcgcggtgctgaaacacattctgaaacatttcgtgaattccgctttttacagaaaagctgggcagaaagcagccgtgttccggctaaggaagtgcggggcgtcatcggaatagccgctgatcaccagacaggaaatttggccgttgagctgtcccgttatttccccgagtctgaaatcattgacgctgcatcaccggaaatatccggggacgcggcccggtttggcggtctgattgatgtgacgggatgcgggacggaaatcaagcatgatgacggctggattcatcgtctgcagtctctcatcgacaacagaaaccgcggccgaaagctacagctgctttgtgtgacaaaggggcttgaaccttttgcgaatgaaacgataaatctctcaggtgcaaaaaaggccggattgtaccggatgctccaaagtgagtataaggatatccgctcgcggcatatggatgcagaacggactgctgaagattccgagctggcaaaccagatcgcagaggagttttttcgcgattctgcagacatcgaagtgtgttaccgaaacggtgtgcgctatcacgcgcggttaaaggaaacaaacagcttagctgaaaaagaattttcatttccgaaagaccatgcgctctggatcaccggagggacccggggactcggatatttattcgcccggcattttgccgaacgttacggagtcacgaaactcgtgcttaccggaaaagaaacaatgcctccgaaagcggagtgggatgatcatatcaaacggaattccccgttttccgataaagtgagaagaatcagagagctcgaacaaaaaggcgtccgaacggaagtgctgtctgtatcttccggccctgaatatgagcaggccgtcagccgggtgaaagagaagatggggccgataggaggcgtgatacacgcagcgggagccgtagatctcgatcatccagcctttatccgcaaaacgagagaacagatgatgcccgtgcttgaacctaaaacagacggactggaccttttgtatcaagcgctgcacaaggagcctctccggttttttgcgctgttttcttcagtgtccggcgtgatgccggaattaggagcgggacaaagcgattatgccatggctaacgcctatatggattattttgcggccgcaaaaggttttccggtgctgagcatccaatggccgagctggaaagaaacgggtatgggcgaatcaaaaagccgggcgtatctgaaaagcggtttaaagagcatcactgacagagatgggctgagcctgtttgatgccgttatggcaggcgattgcggatctgttattatgccggccgtcattcacccggaaaaatgggagcccgaccgtctgatgctttcaaccggccttaccgaaacaaagcagcatgtacagggtgagacagaaagcgtagaggagtggctgacgggcatttgctgccgggaattaagactggagccgtcaagatttgaatctgatacaccgtttcaagattacggagccgattctatcatgcttgcccaagtgtccagagcgatcggaaagaggatcaaagctgaccttgacccggcggtgctgtatgaataccctacggttgctgcgctggcgggatggcttgaaacggcatatccggaaatcaaagctgccgtttcaaaaccggttcagcctgtaatcccggacgttcccaaacaaacagcagccgctgtcattcagccttctggcgctgcagcggcgcaagacatcgctgttgtcggaatgtcctgccgttttcctggagctgaatcaattgaagcttattggaagctgctgtctgaagggtcgtcggctattcaaagggtgccgaaagaacgctggaaaacggagaaggcggattatgcgggccttttaaaaaatgtaacgcattttgacccggagtttttccttattcccgaagaagacatcaaggcaatggatatccagtcctttcttatattagaagaggcgcttcatctgttcagagacagcggttactctttacaagaaatgaaaggcaggtcagccggtgtctatttaggaggacgcggcggcagtatgcctgacgaaaaccgtctgaagcatgcaaaaaatccgatagtcgccgccggcccgaattacttggcggccaatctttctcagttctttgatttgaaggggccgagtctcgttttggatacggcctgttcttcagcgcttgtcggtatgaatatggcgatacaggcgctttcttgcggtgaaatcgactcagcggtggtcgggggagtcagtctgctggaatccggtcaaacccaccggatgttcgaacttcgcaatctgttaagcgaagagcctgcgtttcatatttttgaccgccgcaccggaggcatcgtattgggagaaggcgtcggaatggtgtatttaaaaacagcggcccaggctgtaaaagacggggaccggattcatgcggtcattaaaggcatttccgtaaacaatgacggcagaaccgcggggcctgccacaccgaatatacaggcgcagaaagaagtgatggccaaggcgcttgtcaaaagcggcagaaaagcggaggatatcagctacattgaagcaaacggttcaggctctgaagtaaccgaccttttggaactgagggcgattgaagcggtgtaccgtatgcaaaacagcgcgccttgcgaattggggtcgatgaagccgaatatcggacatccgttatgcgctgaagggattgccggattcattaaaacagtgcttatgctctcgcgccgaatgcgtgtgcctttcctttcgggcaaagagccgatgacgcattacgatctgtccgcctcgccgttttatttttcgcacgttctgcgtgaatggacggattcaccgcggattgccgccgtcagcagtttcgctgacggagggacgaatgcccatgtcatagtggaagcctgggagcaagaggtgtataccccggttagaaagcctttgccgagacaggaattaaaacgccggcccatccgtccggaaaaagctgaaaacctgcatgaaaacgcacatgaatcccgcccgaatacgttttggaaacaaatgaagacttactgattgcgctgaaaattgaacgtcgatatggaggaagttcatatgcaagagcagcttcttattaacaatcagcatcccgttctgaaacatcataaagcctatggaaaggaactgctgccgggtctggcttatattgacctgatctatcagactttcagagaaaacggtttttttcatgccggccttgaactcaggcacttatcgatttttcaccctttagctcctgaacatggagaaacaatcctgctttccgttgactgcacagagaacggcgaagggcagtggaaggtagaggtgagagggcaaaaacaaggtgacgaagcagcagagacaaagatatatgccgcggcgcaaatgcattccgtcaagcccgccggcttccaagagagcgtccggatggatgccgtaaaacaaacggcggcagaaataccgcttgaagatatttacgcggaatgcagggatcaagaactggttcattcaggaatgatgaaaggctgcggaagcgtctaccagactgaaaaagcgatttatattgatctgtcggtgcaaaaggatcagctggaccatgcagaagaggcgatgtttcatcccgcattgatagatgcgagcagcatcggctccaatgtatatctcgctcctttgacgagggaggaggggcaattatttctgccgctgttttatgaatcgttttattgcgccgaattgctgcagacgacatgtatcaccaagataaaaaaagaatccgtcacccgtaagaaagatctcgtttacgtgacaatggagtttttcaatgaggaaggcagaaaagtcggcgaactgaaaaacttcgccaataaacgggtgagggacccggaactgatcaatcagaaacggcaaaagaaagaacctgacgggcggaatgccgtcccggctccgcaagcggaaccggcgccttccgagccccgccgtgcggaggcttccgccggccttactgaacagtgcatcctttatttaaaagaattgcttgccgcccgattgaacaaacctgtgaaagagattgacccggatatcggctactatgaaatggggctggattctccggggctgttggacatggtaaaggaaattgaacgaaaaatcggaacgcagcttctgccgacgctgttatttgaatacacgacaatcgcggaattggcggggtatttgtgcgaacattacggagccggtttcggccatgctcaaagcgggcatccaaatgctgaacctttgcgccgggaaaaaaagaggacgacccaaaaccgcgtgaaaaaatcggcgtcagccggaacgcagaatggagatattgcgatcgtcgggatggcgggacggtaccccggcgccaaaaatcttcgtgaattctgggcaaatttaaaaaatggagaaaacagcgtaacggaagtgcctcgttcccgctgggatacgaggaaatatgagcatttgcgatcgccgtccggcaagccgatttccaaatggggcggttttatagacgatccggattgttttgatgcgaaatttttccgaatttctccgcgggaggcagaagctaaagatccgcaagaacgattgtttttagaaacatgctgggaaacgattgaggatgcaggctataccccggaaacaatcgttcagccgaaagggccgaataagagaatgaacgtcggtgtgtttgccggggtgatgcatatggattattctctcgccggcgctgaagctgcggccaaagggctggtctttccttatcccttgaactatgcgccgatcgcaaaccgggtttcatatttctgcaattttcacgggccgagcatggcggttgacacggtgtgttcgtcatctctgacggccgtccatatggcggcggaaagtctgagacgcggtgaatgtgaagcagctcttgccggaggcgtcaatttatcattgcacccgacaaaatatatcacatacggcttgatggatatgcattcgagtgacgggctgtgccgcacgttcggcgaaggcggcacaggctatgtctcagctgacggcatcggggccgtgctgctgaagccgcttcacaaagccgaagaagataaggatcatatttatgcggtgataaaaggcagcgccgtcaatcacgtgggaaccgtcagcgggattaccgtgccgagcccagtggcgcagggggatatgatagctgaatgtcttgaaaagacggggatcgatcccaggacgatttcttatgtggaagcgcatggaaccggaacttctttaggagatccgattgaaatacaaggtcttgttaaagcttaccgcacgtttacggaggatcggcaattttgcgcgatcggttccgttaaatcgaatatcggacatgcggaatcagccgccggaatcagcgggcttcataaaacggttttgcagctgtttcacaaaacgcttgtcccttctttgcactcagagacgattaatccgtatctccgtttagaggactcgccattttacgtgcagcaaaaaaccgagtcatggaaaaagccggcgtatacagagaacggcagtgaacattcctgtccgagacgcgcaggcatcagttcattcggggcgacgggttcaaacgttcatctcattttagaagagtacaggcccaaaaaccccggcattacggagaatcaagagagaccgtatatcgtgcctctgtcagcgaaaaatccggagcggctgaaggaatacgctgaccgcctgctgatgtttctcaaagataaagcgcttgaaggaagcgggccgctttatgacaaaacagatacaatgcaaaatcagctggaaaatgcgctgcgcggtgctctggccgaagttctgcatgtagaggccggctcggtagatggtgaacaggattggaaggaattcggcttggatgtcatgcagctgacacagttttctgagcggctgacggatcaatacgggctggcaatagacatgactgatctcatacagcatacttccgtccggactttagcagaatgtctgacaaacgatgagaaacataagaatattctttccggtcttttcggtcagtccggcttagagaagcagcctgatgaacctttttccctgcggtcactggcgtatacgctgcaaacgggacggctggcaatggaagaacggcttgtttttttagtgaacgatcaagcggacctgatcaggaaattaaccgaatttacagaacgaaaacggcagattgacggctgctttcaagggcggtctgataacggaacggaaatcaggggtttcctgaatgatgatcaggatgcggaggagctgatccgaaaatggacggacagcggcacttacaaaaaacttgcggagctgtggtcaaaaggatttgagatagactggacgcggctgtatcgggaggagaaaccgcgcaggatgagtctgccgacatatccgtttgcgaaggaacgctattggataccggagcccgatcatcccgtcacttccgtaaatacagaaagcaggcttcacccgctgcttcaccgcaatacatcagatttgttagaacaaaaattcagcacggtactgaacggagatgaattcttcttagccgatcatatcgtccgaaacaagcgtgttctccccggggcggcttatcttgaaatggcgagagccgcggctgaactggctgccgcgccgttagccgctgaatacacggctaaaaccggcatttcgctgcgctatatcagctggatacgccaggccgttcataaaaaagagccgctgcgtatgacgacaggtctttccttagaggataacggcaatgtttcatttcaagtgtacagcaatgaaaacgattcagacatttattgtgaaggcagtgctgtgattgagccgctgtctgaggcgccggttttgcatattgaacagctgaaagcgcgctgccgcaaaaaagtgctgtcaaaagaagactgctatgcggcatttgcaaaggcggaaattgtttacggaccttcacatcaaggaattgatcacatttattgcggggaaaaaatagccttggctaaattggtgctccctgcttccgtttgtgatgaggccgaacagtttgtgctccatccgagtctgattgattccgcttttcaggcggccatcggcgttatgaatgaagataaagcgggttatccggagcagccgttaatgccttttgaattgcatgaactgaccgtttttcatccgtgcagtccaaacatgtgggcggccgtgtttgtgacgcatgaaacaccggccgtgcgaagaatggacattgatatatgtgatgaacgcggcaatgtgtgtgtaagaataaaaggattttctgcccggatggccgaaagtgcgccggctgaaacggatgacaagcaatacgatctgccgggtaaccttaccggagccgtcaaactgatgcaggtatgggacgcggaaccgatagacaaccaaaccggcttccccatttctgaagcaaaagctgtcatcataggcggtacagacgggcaggcggacgcggttttacgattgtttcctaaagctgtgcgatttgatagcagccaaagtgcttccgttgaagtgatatccgatcggctccgccgtctcggtgagattcagcatatgatctggtttgcccctcagccggctgattcttacatccatgatcaaaaaaacggggtgctgcaaattttcagagcggccaaagctcttatcggtctcgggtatggaaaagagcagctcgggatgacggtgattacgcaccaagcacagcctatcacccaatatgatgaggtgcgtcccgctcattccagtgtgcacggtttcgtcgggtctcttgcaaaagaacatccgagctggcacatccgtctggtcgatcttgaagacgggggggatttccccgcagaagacatattcagcctgccccgcgaccgtacgggtaaagcatgggtgcgcagacatcaggaatggcaccggcctcaattgcttccggtccaaagcgggccgtctgaaagtgttccttaccgatatggaggcgtatatgtcatcatcggcggtgcgggaggcatcggcgaggtttggacagattatatggtgacgacgtataaagcccgagtcgtctggatcgggaggcggccgctggacagccggatacgccaaaaaatagaccggtaccggccatcaggcccggctcccgaatatatagcagcagatgcttctgatcttccatcgcttcagcgcgcctatgaacagattaaaaacacatacggcaccatcagcggcgtcgttcattcagcgatggtatttgcgaatgaaagcgtaaaagatatggaagaatcacagtttcacgccggccttgcggcgaaagtggatatttccgtcaacattgccgaagtatttgcgaaagagtctttggactttattctctttttctcttcggttatttcatatattaagaatccgaatcaaagtcattatgcggcggggtgcgcatttaaagacgcatttgcccatgagctttccggacggctgtcatgcccggtcaaagtgatgaactgggggtattgggagcgggctgacaatcacatttctgaagagtttgacagactgagtgcaatcggtctcggactgatcagccgggcggaagggatgcaggcgctggaaactctgctgacgcagccgatctcccgcatggggctgatgaagctgaccaagccgattccgatcgagggaatgaaccctcatgaatttgtgactatctgattgcctgtcaaaatgacggagcaaatttaattttcttaggaggataaggttttgggtaagggagacaaacaaaaagaccgtacacagttatccttaagaacagaaataagcaatcaaatgaaagaattgaatcggcttttgctgcaagtgctgcgggtgacgctgcgttcaatgggtctgaccggcgaagcgccggcggcttcctgtctgcctttatatgagcgctggctggaagaaagcatccgccttttagacagcgatcttaaaagcggtgaaacggccccgatttgggaagagtggcataagaagaaaaacgaatggctgaaagatccggatatgaaagcgcaggctctgctggcggatactgtcattcaagctttgcctgacattttaacaggcaaaataaaagccactgacgtgatgtttcccgattcttcaatggagcttgttgaaggaatctataagcataacattctcgctgattattacaacgatgtgctggcaaatgaagcgtgtatttatgtggaaaatgtaattaaaaacaatcctgaggcaaacatccgtctgctggagatcggagcgggcaccggcggaacgagcagcacactgtttaaaaagctccgcccctatcaaaaccatattcaggaatactgttataccgacttgtcaaaagcttttttaatgcatgccgaaaaggaatacggcgcggacaatccgtatttgacgtatcagctgtttaatgtggagaagcctgcggcgggccagggattacatctgagaacctacgatatcgctatcgccgcaaacgtgctgcatgccaccaaaaatatccggaaaaccttacggacggcaaaagccgtattgaaaaaagacggtttgctgctcgttaatgaactgggcgggcatacgccgtttacacatgttacattcggcttattagagggctggtggctgtacgaagatgaggcgctgcggattccggggtgccccggcctttatccggaaacatggaaatcggttttaatggctgaaggctttcattccattcaatttccggctgaaaacgaacgtctgcacacccagcagattatcacggcgaaaagcaacggagtcatcaggcagagcagggaagcttacaccgcgcaaaagcgccaatcaaacgtaccgcgaacatcctctgatcgtcagctccccatcaaacaagcgggagaagggctttcggaaaagacagcagcttttctgataagggctgcggcaaaagtattaaaaatgccggcagaagagataaatccgctggctcctctggatgaatacggcattgactctattctgatcgttcagctgacgaacgagctgcgggatctcgtccctgatatcagcagcacgctgttttttgaataccggacgatagaagagcttgccgcatacttggctgaaacgaaggagagcgaactgcttgcgcgattttctgaagaactccgtcatactgaagcggtatcatccggatctttgcttgaaaaaagcacagagtacctgaaacagatcgtcagcgtcatcttaaagatgccgattgaggacgttcaagcccatacgccccttgaagaatacggaatcgattccatcttaatcgtacagctgaccaaccgcgtgcgggaagacgttcctgatatcagcagcacattgttcttcgagtatccgacaatcggcggattagcggaatatctcgtcagctcaagacaggaagatatggctgggattttcaagacaaataaagaagccgaaaaggtgccgcacactctacagaaaaagcaaagccgcaaaaaaagcgccggattgacgaagcgccaagcgtcatctttttctgaaaaagcgccgcccgcttccgaaccgccgtcaaaacaccttgaagtggcaattgtcggtcttgccgggaagtatcccggagctgaaaatgttaatgagttctgggaacggttaaaaaccggtgaacacggaatcaccgaaattccgaaagaccgctggaattggcgggactactatgatgagacaaaaggtaaggaagggcggatgtatacaaagtggggcggttttttaacagacattgataaatttgatccgctgttttttaaaatctccccgaaagaagcggagcgcatggatccgcaggagagactgtttctggaaaccgcttatgcggcccttgaggatgccgggtatacccctgattcactatgcgccggtaaaaaggttggtgtctttgcgggtgtcatgaacggcaactatccgacaggggcccactaccactttatcccgaaccgcgtatcctatgtgtttgattttcacggtccgagcatcgcggtcgataccgcatgctcctcatccttaaccgccattcatctcgccgcagaaagcatcagaacaggtgcatctgaatgcgcgattgccggcggcgtaaacctgattacagatccggtccattatatcggactatcttctatgagaatgctgtcgccgtcaaacgcgtgcaaagcgttcggtgataaggctgacgggtttgttgacggagagggcgtcggctgtatcgtgttaaagccgttgaagaaggctgttgaagatcatgatcatatatacggtgtcattaaaggaagcgctctgaatgccggcggcaaaacgaacgggttcaccgttccgaacccgaatgcacaaggggaagtgatcgcagacgcaatggagcgggcagggattgacccgagagcaatcagctatctggaagcccatggaaccggcacttccttgggagatccgattgaaatcgcggggttaaccaaggctttccgccgctatacggatgcaaagcaattttgttccatcggttctgttaaatccaatatcggacacctggaaagtgcggcgggcattgctgcggtcaccaaaattcttcttcagatgaaacacggatatctggtgccgtcgctgcattcaaagcagctgaacccggaaattgattttgaaacttctccttttatcgtgcagcaggaaacggcggaatggagacggccggtcatagaatctgaaggagtaacacgggaatatccgagaatcgcgggtacatcttctttcggagcgggcggggcaaatgcccacctgcttatagaagagtatgaaccggctgaaatgacttcggcggacttcggccgtccggcgctttttgttttatcggcaaaagataaagaccgcttgcgcgagcgggctctgttgctgtcgaatgccgccggaaacggaacaattacagatgcaaatctgcttgacgcggcatttacccttcaagtcggcagggtcccgatggaagaacggctggcgatgacagcggactctgtttctgaattggaacagaagctgactgcttttctgaataatgccggttccgtaagcggggtgtttacgggccggagtgatagtgctgtcacagagacggaaggcacagtcggtgattggatggaaaaacgtcaatttgacagtcttttgaatgcctgggtccacggggcgcccgtcgattgggcatctttatataaaggcgcgctgccgcatcgtatcagtctgccgtcttatccatttgcaaaagaaagctactggatgaagcgggaagaaccaaaaacaggaacaactgaatatgtgcatcctttcctgcatgaaaatacgtcaaccttggcggagcaaagctatcatacatcttttacaggccgggaacacgttttccacgatgtgagaggggagcgggttctgtcggcagccgtttatttagaaatggcgcttgcggcttatcatcatgcggcagacagctctgaagaaaaagagatatggatccgaacagcggcatggactgacccgattaccagcggacatcacggtgcgggcgtcaatctctcccttctgtctgaagacgaggaaggcatccattatgaaatatacagtgacgaagagaagctgcatcattatggaatcatcgggcaagggaacatacagccatcccgcgtgcttgatattgcctccttacaaaaagactgccgcccgttgtcattcgattatgaaacaccaggcacatcaggtgtaacgatcagtaaagagttccgcaccgttgaaaagctttatacgggagaaaatacggtttgggcgaagctggctctcacagatgaaagcgtccgtaatccgggatatcatctgccgccggaatttctggacgcagcttttcatgtcctggcaaaaacggagccgtcagtccatatcgtgcctgaagcggttgaagaactgcgcgtcatgcgtccgtgctcatcccgcatgtggatgtatatgaataaaaagaatcaaaccggctgtgacattcaattttgtgacgaaaccggcattgtctgcgcagaaatcaaaggggtgagaatgagaaagccgtctcagcaggatcacgggcaagaagaacaatccgagatgatgatgtttgaagaaatgtggacgcagcagcctctgatgaaatccattcatgaagagctgaaaacggtcatctgttttcttacgggagaagctgccagaaagcatgcttatcggtctttacaatccctttatccgggagccggcgtgttttttgtttcacagggtgaggaaactcaaaagctttcaaacacgcattatcaaattaaaatcactgacggacaagcatatcaagaaacgtttcgacatattgaaacggctgcaggcaaagcggatgccgttttgtatggatggccgcttgaagatgaaaaggccgtgaaagactattccattctgtatcatgtcatccgcgcaacggcttctttgcgttctaaaccgaggcgaatccttctttccgctcagtgcgggaccgatgccgatatcagttacgccgagtcatggatcgggctggaacggtcgctgaaactgatcctgccggagacggatacggccgcggtttattttggacaaaaaggaccgtttgaaaagctgatccgtaacgtatgtgaagagcttcacagcgagtcgttccgcagtgtcatgtacagtggggaaatccgtcacgtcatggaaatgaagcagacggatattgcccatgttgagaagcgtgtgataaaaagcggaaaaacgtacttgattaccggcggatgcggaggtttaggcttattattcgccggatattttgctgaaaaaggaccggttacgctcattttgacggggagatcagcggcagggggcccggtgctgaacaagataaagagattggaagaatcaggcgccaaggtgttttacgtgcaggcggatgccgcagatcaggctcagatggagaaaggtttgcaagaagcgaaagagaaaggatgcgggccgattcacggtgtcattcacgctgcaggtcttcaaggcactgaaagcattctggagaaagatctgcaaacctttcagcaagtcttatcgccaaaagcggacggcacagcggtgttagatcaggttctgtcacgggagccgcttgacttcttctgttgtttctcttcttcttcagcgattttaggagacttcggttcttgtgactacgcaatggggaaccgcttccaaatggcttttgtccgtcaccgggataaacttgtgagtctcggactcagaagcggcaagtcacttgcaatcaattggccgctttggaaagaaggggggatgcatgtcggcacggcggaaagcaccgatatgtatttaaaatcaagcggacagcgttatttatatacaaaggaaggactcgaagcttttgaaacattgttggtccagccgtccagccagtatctcgtgctggccggttttccgtcgagggccaaacgcttcctgcagatagatcaaggcgaacagccgaattcgggttctgaaaacaggaacgtcccgttttcaggaaggcggagtgaaatgaaaggctttacactggaagaatgcgtaagctgggatgtgaaggaactggcggcggggcttttgaaaatagacaagaacagactgacggatgctgacaatctggctgatttcggctttgattctatcagtttggcggaattcgcctcttctttgtccgctcactacggaattgaagtgaccccggccctgtttttcggacattccacactggagaaggtcgtccgctattttctgacggaacacaagtccgtcatagagcatgtctatgaagaaaagaaacctgaatccgcagatcaatctgtctttgaaaagacagaaacggaaaagcgaaagaagcagaggggaagaaataagctgaacgccggaaccgagggcagtcaggcagctgattccattgccattatcggcatgagcggccgatttcctcaggcgcgcacggcggacgagctgtgggacattctgtttcaggaaaaggacgttgtcgcaccggtcgcaaaaaaaggcttcacaagttcaaaatggaaactcggcgctgtaccgggggcggacgaattcgaccctttattttttgaaatatcgccgagggaagctgaaacgatggatccgaagcagcggcttcttcttcaggaagcgtggagggcccttgaggacgccggctacggcgccagtcacatcaggcagcagacgatcggtatgtttgtgggtgcggaagaaggagattatcaccttttaacacgggacaaaggcaatgtcacgtctcatcataacggtattttggcggcgcggctggcttatcacttgaatttatcaggtcctgtgatggcgataaatacagcatgttcttcggggctcgtttctgtccatcaggcggtattaagcctgcagaataaagagtgcacaacagctgttgcggccggggtgaatatcatgaataccccggacttttttgaaacgatagataaagccggaatgctgtcggaaaacgggaaatgcttcgcgtttgataaaagtgctgacggcatggttcccggggaagcggccgcggcggttgttctgaagccgctgagagaggcggaagaagatggtgatccgatttacggggtgattcgggctagcggcatcaattatgacgggaaaacaaacggaattaccgctccgagcggcgtcgcgcagacccggctgcttacttccgtttatgaccggggccgtatcaaccctgaagatatcgaatatatcgtcacacacggcacggggacaaaactcggtgatccggtggaaattaacgcgctttatgacgcattttctgcctatacaaacgaagaagcattttgcgcgctcacatcaattaaaaccaatatcggccacacgtttgccgcgtcaggcattgtcagtttgatcagtcttttacaggcattctcccgtgaaatgattcccgccagtctgcattgcagcggggaaaaccgctatatcaactgggagaagagtcctttttatgtgaataaaacgggtaaaccgtggccatctctgccgggtaaaaaccgaatgggggcagtcagcgcattcgggatgagcggaacaaacgcccatgtcgttatggaaagctataagcgcagcgcttcacctcatccggatgcccctgcttatttactgactttatcagcaaaaacaaaggaggcccttcaggaaaaaatcgaagatatgatcacttgggcggaaaatggcggactgaaagaaaatgatctagcccagctcagctatacgttgctaaaaggacggcatcactttaaccatcgcgccgccatcgtggttcaagatgctgatgacgcagcgtatgtatggaagcaggcaaagcttaatgaacatcatccttatgtgttttcgggaaaagtaccgcagcactttgcaggccgacagcatattcaggagcacataatagaagtgctcgtcaagtgcagcgcctcatattctgaccatagaaaatatcaggaactgttatgcgtgctggcagatttttattgtcaaggttatgaaatcgaaggggacttgctttatggcggacctttgccgcgaatcggcaatctgccgggctacccgtttgcaaggcagacgtattgggcgtccgatcgtcttcagggagagcttgaaagccggaattcagctgaaggtgaaaagcttcacccgctgctccatgcgaatacatcgacctttaccgcccagcgctttacttctgttttttcagggcatgaaccgttttttgctgatcacatcgtcaatggaaaaccggtgcttccgggcgcggctgctttagaaatggcccgggccgccgttacgcttgccgctgaagacttgccgggcgggaaagcgggtgtccggctcaaacagatcgtttggctccgtccggtgacggtgctttctgagggagtgacgcttcatgtaaagcttcagccggaagaaaacggagacatcgcttttgaagcgtatgccgaaggggaagagccgcttgtctttttccagggaaaggccgtgctcgaagagacggagcgtgctccggtactcgatatggaggcggttcaaacgcgctgcggcggccggcgcatgtcaaagactgagtgctatgaagcattcgacagtctcggcatcacctacggaccgtctcatcaggcgcttgacgccgtctatgccggaagcggagaagtgctcgcgaagctcactcttccgctgtccgcccgcgaagaaaaggagccgttcatcctgcatccgagcatgctggacgccgcccttcaggcttctatcggtctcgtgctctcagacggttccgcgtccggacggccgtttctgccgtttgccctccgggatatgcaggtgttttctgcgtgccgggagacgatgtgggcggtgctttcctcagcggacggcgcctatcatattgagctgtgtgatgaaaacggcgaggtatgtgtccgattgacggggctcaccgcccgttttctggaggaggaaacggagggaaaaccgctcttgcttcagccaaagtggcaggaatcaccgccgggtgaagacggcggacaagaagagtctttcagatacgtgacgctgtatggcggaatgaacgctgaggacataaacggcgccgtatgtgcggctgacggcgaaggtccgattgaagatcgttatgacgcctgcgcggcggagctgtcagcgatcgtcaagcgtcttatcaaagaaaaacagaaggaaaaaacgctgatccagcttcttgtccccgacaggggggaagacaatgtattggcggggctggccgcttttctgaaaacggctcaccttgaacatccgaagctgtacggccaagtcatccaagccgatccggacgagtcagcatcagcgcttcttgccaagctgaaagaaaaccgggcgcatcctgaacaagcggaaatccgttatgaaggcggcaaacgtttcgtcagaaactggcgtcacctgccggcctctcaaagcggcgccgttccgtggaaagacgaaggggtttacctcctcaccgggggagcgggcggcatcggactgattttcgctgaagaaatagcctcccgcgtcaaaaacgccgtcctcatattaacgggaagggcggaagcgctagatgaagagcgctccgcccgcttaccgcgcttggaagcgtcgggtgcccgcgtattgtatcaaccggttgacgtgacagacagggcggcggttatcgccctcgtccgcggcatacaggaggagcacggaacactcgacgggatcattcacggcgccggcgtgatcgccgacaactacattctgaaccagacagaaaacgaacggaaggccgtcatggcgccgaaagtgaaagggcttatcaatcttgatgaagcagcgaaagatgtgcggctggactttttcattctgttttcttccttggcgggaggcatgggaaatccggggcaggccggttatgcggcagccaacgcatttatggatgtttatgcagcccgccgaaacaggctcgtgcgggacaacaatcggagcgggcagaccctgtccgtcaactggccgctttgggaagaaggcggtatgcgtgtggacaaagagacagaacggctgatgtatgaacagaccggaatgaaagccatgcgatcggcatcaggcatccaggcgctttatgccgcttttgcctccggagcacaccaggtcatggtggcagaaggcgacgagaaacggattcgcagccatattttcgatctgggcgaagaacaaagcgccgccggaaaagctccggcagagacagatgcaacagatctgaaagatcgggttcaagagaaactaaagcggcatgtatcagatcttttaaaggtaagcatgaaagatattgaggctgacagcgaactgacggaatacggatttgattcgatcatcttcactgaatttacaaatctattaaatcggtcttatcagcttgagctcagcccgactatcttctttgaatttccgacattgcgcaaactgagcggccatttgatatctgaatggaaagaagcattcagcggcttagaaagagagcgtttaaaaaccgctccaaaagccggaataagaaaagctgaaactccggcggccgttcatgtcaagcgggaaacgcccgtatccgtaaaaggaaaatcagaagaaaaaaccgaaccgatagccattatcggaatcagcggtatttttccgcaagcgaaagacatagatgaattctggacacgtttatcaaaaggagagcattgcatcacagaaattccccgggatcgctgggattggcgcgaatattacggcgatccggcagcggatgcaaataaaacgtcaattaaatggggcggttttatagatggaatcgccgggtttgacccgctgtttttcgggatatctccgaaagaagctgaaatgatggatcctcagcagcgcctattaatgatgtatgtgtggaaagccattgaagacgcggggtactcagcaaaacggattgccggaacaaaaaccggcattttcaccggcacattgggaagcggatatcaaaccttaatcaataaggcgggtcttcctgtcgaggggtatacgatgaccggaatcgtgccgtccgtcgggccgaaccggatgagttattttcttgatatccacgggccgagcgagccgatagaaaccgcttgttcaagctctttagtcgccattcaccgcgcggtaaaagccattgaaacgggagattgtgatatggcggtcgcagggggcgtcaacacgatcgtcacgcctgaagggcatatcggttttcaaaaagcaggcatgctcagtgaagacggacgctgcaaaacattttctgatcaggctgacggttatgtcagaggagagggtgccggcatgattgtcttgaaaaagctttcagaggctgagcatgacagggatcacatctacggcctcatccgcggtacagcggaaaatcacggcggacgctcagcgtcacttaccgcgccgaacccgcaggctcagacggatgtgctgaaaagcgcttatcaaaaagccggtattcacccgtcaacgatcacttatatagaagcgcacggaacaggtacggcgctcggagatccgattgaaatcaatgcattgaaaaaagctttccaaacagacggggctccgggcggatattgcgggataggctcagtgaagacaaatatcggacatttggagctcgcagcaggcattgcgggcgttatcaaagtattgatgcagctgaaacatcggacgctcgccaaaagtctgcattgcgagaacatcaatccccatatcaaattgaaggacagcccgttttacattgtgacagaaacaaaggagtgggaagcgctgcgtgatgaaaacggccgggtcctgccccgccgggcgggtgtaagctcattcggtttcggaggcgtcaatgcgcatatcgttattgaagaatacatgggcaaaagtgagacggaacagccggaaacccgtgagaaagcgtcatctctttttgttttgtcggctaaaaatgaagagcggctgaaagaaagagcgcgtctccttcgcgattttatccaaaacggatcatcccgccatatcgatcttgcagatgttgcatacacactgcagaccggacgggacgcaatggaagcgaggctgggaatcattgcaggctccgcagaggaactgactgaaaaactgaacgcgtttctgacgggaaaaaacagcgaagatatcatcagcggccgtaaaaaacgcgagaataacacgatctccatgttctcagacgatgaagacgcagctgacctcgtcagcgcctggattgagaaaaagaaatacaagaaagtgctgcggctctgggtaaacggatttgacacagattgggagcagctgtatacggacagtaagccgcgccgcatcagcctgccctcctatccgttcagagcagaccgctattgggtgccgaaacgggagcagctgccgctttcgaatcaaaaaacagtagtattgcagaaaacatgggagccttgcgaggcagtgtcttcatccgagccattcagcaaaatagcgctcatcgtctccgaggatacaaaagaccttgccgccgaggtgaaaaaacagctgaatgatgctgacattgtgcaggaaaatcagctcatctctttcttacaggatgcgaatgcggccatctattccgggtttattgacttcaccggctgcggctcccgacaaaagcggcaggacatcagctgggtggcatcgctgcagcagctgattgaatacggccgcggacaagaaaacatgaaaatgctttatcttacaaaaggccttgaatccttcaaaaataaggcggccgctatgcatggtattgaaaaagcggggctttatcgcatgctgcggcatgaatacagccatattctcacctgtcacgccgatattgatcctgaagagccgctggagcagacagccgcttttattaaacaagaaattgaatcagacttaacggaatctgctgtttgctacagggacggcatgcgcttcagctatgttcttcggcagactgatcagattgaaccagaagccgtgcaaacagaccggactgtgtttccaaaagacgccgtcctcatgataaccggaggaacgcgcggactcggcgctttatgcgccaagcatttcgtttccgcatacggtgtgaagaaactgcttctgacaggcagaaaggagctgccgccgaaaacagagtgggatcttgagcaaacagaccctgtcgtttcggaaaaaatacagcttatccgaaagctggaatcacagggcgtaaaagtgtgcgtctcagcagttgatctgacggataagcaggccgtcggacggcttataaaagaggtaaccacaacgctcggacctgtcggaggcattctgcattgcgcaggaattgcggaccgtgaaaaccctgcttttctccgcaaatccaaagacagtatcgcgcgggtgctcgcaccgaaagcagacggcctccgcggtctgtatgagagtgtaaaggatgatgcgccggcatttttcgtcctgttttcatctgtctcggcagccgtcccgattcttgcggcgggacagagcgattatgcgatggctaattcttatatggactattttgcagaaaacaatgagggcggcatcatgagcatacaatggccggcatgggatgagacgggcatgagcagggatacaaaaagcgggatgtatcagcaaacgggattgctgcgtcactctgacgcggaaggtctcaagatgcttgattacattttaagagaaagacccggaactgtcgtgctgccggcacaagtgaaaaatgattgggacatcaaagcgcttgaaaacgccaagccagccgcccataaaggaatgagaacagcttccaaacctcctgaaacaaaaaaacgggtccataaccggactgatattcaatcttggctgaagtcgcttttggcaaaagagctgagtatcgatgaaacgcatatggatatcgatgtgccttttcaggaatacggaatggattctatctttctggcgcaagtgctgacaaagatcgatcaaaaactgccgtccgtttcaattgatccgactgtccttctggaacaccctaccatagaacagctcgcggattatttagccgcacattgtccggaagctttttcggcagatgcagcggttcccgcggagaaggtccctttgcagaaaacgccgaaacagagcaaaaaaacggcagataagcccgggaaacggggaaaggttgcgatcatcggcatggcctgtcattttccggaagcgggggatataaaagaattttggaagaatctctgcagcggaacggatgccgtcactgaagttccgccggacagatggaacgccggggaacactatcagccgggtgaatatcaagaaggaaaaagcatcagtaaatggggcggttttattcaggatattgatcaatttgacccggagtattttaatatttcagaaacgctggcaccgatgatagacccgctgcaaaggcagtggctcgaagtgagcgcggaagctttggccgatgccggttatcaaaaagaggatctctggggccgccgtatcggcgtttttgccggtgcaagggcaggtgcgtttcatcagaaatttcaatatttgcaaaaagacgcgattattggcgcggggcaaaattttattaccgcacatatggcgcacatttataactttacagggcccaacctggtcgtagatacggcctgctccagttcgcttacggcaattcatttggccgtgcaggctattcaaaatggagaagcggaggcggcctttgcgggcggggttgacattttgcttgatgaaaaaccttttctcacaatgagcgcggcgagaatcttatcgccaaatggccgttcaaaatctttcgatgccgatgcggacggaacaggaatcggagagggctgcggtgtgctgatgctgaagccgctcgaaaaagcgatagaagacgaagataaaatatacggcgttattgacggctctgcgataaataatgacggcagcacaatgggggtgacgacgccgaatccccgggcgcagcaggacttgattgagcaggcggttcaatcagcggaaatcgagccggacaccatgacatacgtagagacgcacggaaccggtactttgatcggcgacccgattgaattaaaaggattaaccaatgtcttgtctgcttattccgatgaaaaacaattttgcggtgtagggagcgtcaaaagcaatatcggccacttgctgagtgcggcgggcgcggcgggaatcatcaaagttttgctggcgattgccaatgaagaactgccgccgactttgcattgccataaaccgaacccccgctttcaatttcatgattcgccgctttatcctgtgcttgagctgaagcggtgggacggaaaaaaagagatactcagggccggggtcagcgcgttcggtttgggcgggaataacgcccatatcattgtcagcaacgaaggaattccgaaagaacgaaaagcgaccatggaaccgaaaggcggccagacagtataccgaaaacagcggtattggcctgaaaaagcacagttgtccgaagcggaagaaaatgaggcgggcacagaagcaatgtttgaaataagcgaggtgtgatagattggcagttgccaccgatcaagtcaaaacgttcctgcagaaaatcagccatacgaattatatcgtccgggatcatcgcgttcaccaaatccgcgtcctcccgggcgtgactttaatagatatgctgtatcggctcgccgccgggtatctcggtgaaaggcctatagaattaagacagattatttttaagcagcctgttgtaacatctgaagagtttgataaacacctgtatgtcacctttacgccggcgcgtgacagctggaaagttgagattacaagcgaaaaagcaaaaaacggcacaccgcttggcggaaaacgggatgagaatatggaatgtcagctttatttgcaaaaagacacgccccgggcaaaagagctgaatattgaagcattcatgaaaaacgcaagccgaaaatgggacatgcatgacatttacggaattgcaagaagaagccatattgagcatggcgagtttatgaaaaatgaaggggccgtttatcagcttcaggataaagaagaattaatggagctcactctgagtgatttggctgaaggattccgggagaaatttaaggcgcatccggcttttttagatgcgtccacccttgccggctcttcctttgcattgtcggcccaaaagcagaatgacacaccttatattccttttatgattaatcgtttttgcatatatcagcggtttccaaaaacgatttacacttattctgcgaaaaacagccgcactgaaagcggcgcatcagatagcgaacctgatttttattcggccgacttcacgatttacgacagggcagggaacgtattggccgaatgtgagaaactgacagtaaaaagggtcagacaagcgaatatgattacccatctgatagacaaagagaagccgcctcagcagaacagaagcggccgtggagagcccgaaagtcctgtggccgcagaagacgtgtctgaacagcaaacgtcggaacaaaacatggtgacttacataaagtcggaaatcgccaggctgatcaatcgtccggcacaggatattgatgtgcggaaaggcttttatgatatggggcttgactcggctcatttgctgaagcttgtaaagatattagagcagacttttcagcagcagttttatccgacactgctttttgaatattcatctgtccgccgccttgcggattaccttatcaatgaagcgggctgtgtgctgaaagattcggccgaagaacggcatacatcagacgctgacattgctgatgaggttctgttttttgaacccgcctggaaagatcatccgctggaaacggcggtgcagaacgggcaaaaacacacccgtcatctcattatcgctgccgatgcaggaccccgtctcaccggtgaactcggcacacattgcccggaagcggaagtgatagaactgaaaagggagcatgaggttgcagatgagcagtttggagcagatgccgagcttatatttcgtatgctcaaacgggaactgacagaccatccgaaagaacatacattgattcagcttgtatgcgccgttgagaatggagcggcattgtcttccgctctcggggctatgctgaaaacggcacatctggaaaatccggctcttcgcactcaggtgatcaccttctgtgacaagaatgagagattgccaagtgagacggccgcaatcattagaacagaagcagactgctctcatgcaggctgcacagacattcggtataaagacgatatgcggcagatcagattgttcgaacgtattgagaaaccggacggacagacacagtctccttggaaacaaaacggcgtatatgtcattacaggaggtctcggcggtcttggatttctgcttgcccgtcaccttgcagaaaaagaaaaggtgaagctcgcactcatcgggcgttcgccggaacagtctgagaagatcagcagactgaaagcattgggagcggaagttctttacgttcaagcggacatcggcagcaaagccgaaacagagcgggcatttgctcagattacagaaattttcggccgtctgacgggcatttttcattgcgccggtgttttaaaagatcaatttatcatccaaaaagacagttctgacttgaagcgggtgttcctgccgaaaatcagcggcctgattcatgcggacgaagcctcacggcatgaaccgcttgaatttttcgccgcattttcctcattctcggcgttgaccggaaatgcgggccagacagattatgccgcagcgaacgcttttatggatgaatatatgaaatatcgcgattgcaaagcggaaaaaggcgaacggaccggggcttctatgacgatcaactggccgctttgggaagatggcggcatgcaggttgacagtttgatgaaagagatcatgaatgatgcaaccggcaccagcccgcttccggccggggaagggatggcttcactagaatatatgctgcgtctcggcaagctgcaatccgttattttatacgggaaggagcctgctgtaactgaaagcatggcccgattggttccgatggcagacaagaaccgctcttcattatcccatgcagctgtcaagagaaggagccgaaaacaagagagacatacagaagagcacgatattgccgtaatcggattggcgggaagatatccgcaggcgggaagcatcgatgaattttaccaaaatctgcgctcaggtaaagactgtatcacaacaatgccgaaagacagatggaaaggttatcctttctcatatgaagcagatcagttctaccgttacggaggatttttagatcgcatagacagctttgatccgctgtttttcaatctgactccgcgccaggctgaaatgatggacccgcaggcgcggctgtttttagagacggcttgggaagcttgtgaagatgccggtttttatcaggacagaacggcgcgcgggccatcttcacaaaaaagaaaacgcgtcggggtattcgcaggtgtgttttggagccattatgagctgttcggcgctgaaatcacacagcggggcacaccgctgtctatgggcgtgacgcctgcctccgttccgaatatcgtgtctcactgcctgaactttacagggccgtcaatggctgttgatacgatgtgctcttcttcgctcacatccatacatttggcatgtgaaagcattaaaaggggggagtgcgaattcgccattgccggcggtgttaatgcggtcacacatccgcataaatatgcgtttttggcgaatgccggatttctgtcttcagaaggcgtctgcaaaagcttcgccgacggcggtgacggctatgtgccgggagaaggcgtcggcgcggtgttgctgacaaccgttcaagaagcggaaaagatgggctgtccgatatatggcgtcataaaaggctccgctttaaaccatgtcggaaaaacatccggtttgaccgtgcctgatccggcatcacaggcggaagtcattacagattcctttcagagtgccggcattgatccggagacattgagctatattgaagctcacggaacgggtacgtctctgggtgatccgattgaaattgaagggctgagccgcgctttccgcaaatggacaaacaaaaagcggttttgcgccatcggctctgccaaatcaaatatcggccatttagaaggagccgccggaatcgccggattaacaaaggtgcttttgcagctgaagcatgtagaaatctttccgtcattgcacgcggacacgctgaatccccatattccatttccggatacgccgttttatgtggcggaccggctggaagaatgggaacggccgtcacatcctgaccagccgagaagagcgggtttaagttcttttggcgccagcgggagcaatgcccattttgtcatagaagaatatctgccgccgcaggctgaaaagaaatcgctgagtatacgggaagacgagccggttctgtttctgctttcggcaaaaaatgaagaacggctattggaatatgtcaaacggtatgaccgctttttacgggaaaaagaagtcaatcttaaagacctggcctacacgcttcaagcgggcagagaagcgatgcctgaacggctggcattgatcgttacatccgtttgcggcctgcaagcgaaactgaaggatgtgcttgaacggaaaacggaaattgaagggtgtttccgcggacgtgctcaagatgttatttcaacaagtggaatggccgagcttttgaaaaacaagcaatattccagattgctcacggagtgggcaaaaggagccgccgttgactggagccagttatacgaaggagagaagccgaaacgggtcagccttcctgtatatccgttcgcgaaggagcggtattgggtgcctgtgcctgcggatatccggaaacagacagacgaaccggcggaaaaccaaaagatcattcttcaaaaagactggaagcagcaagatccggcggagtctgaagcattatcaggaacagtaatgatacttgcaactgataagacgagccgattggccgatgctctatttaaaggaaacggccatattgaaacgatctgtttcatccatcaggcaaaagacggcgccgattattacgctgccgcatcggggcgaaacctttacggcagagtgcgggagtctcttcaaaacaaacagatactcggggtcgtcgacataaccgcatatgatgcggaatatgaacggcgggaagatatagaatacggaaagcttgcctttttacagcaggttctggaatcattccgtcatagcggcgctgtgctcagccaagtgacacaccgcctccagcctttcaaggaaagtaaacctctgatgcagggggcgaaaacggcggggctgtaccggatgctgggcgctgagtatgccaacattcattcttttacgatagatagcgattgtgcgattgagcatacagaagaattaagcagacagattgaaactgaatttttacagccgcgggccaaaagcggcagtgaatgctgctacaggctgaatcgccgttatgtgccgtttctgaagccgggtacgaatgtgtctgcggtgcctgagctttcctattcgtctgatgatgtgctgttaataacgggcggatcgcgcgggatcggcgcaattgcggcggagcatgccgtttcacgcgggtgcagaaaactggtcatcatggggcgggagccgcttcccgattcctcggagtgggaagacatgaaaaaggacggcattctcccggaaaaagccgagcggatgcagaggttagccgagcggggcgcggagatccgttattacagcgtttctcttacggatcaaaaggggctccggaacatgacggacagcatccgcggcacaatgggaccgattaccggtgtttttcattgcgcgggtgcaatgggagaacaccccgctttttataacaaaaccgaaactgagatcgaaagcgtttgcacgccgaaagtaacagggcttggcggtctctatgaagccgttcggaatgagccgctgtcgttttttattttgttctcatccgtttcgggtctgatcccttcgcttgctgcggggcaaagtgactacgcgatggctaattcatttatggactcttttgcaaatcatcaggcaggcaaaggaaacgtgtttgttaaagccgttcaatggcccgtctggaaagaaaccggcatggctgaaggcctgccggaaacacctgcttatcaaaaatcaggactttccaggctgtctgccgaagacggactgaagtttttagattacatcatattaaacggacaaagctgcggaattccttgtgttcccgaagacagtaaggctgattttggtgatcttctgaaggtgaagaaaactgaagctcccatgaaaaaaagcagtgccggtgaccaaaaggtgaaggatatgattcgtcaatgggtgcgcaccgttttcagcgaagaactgaaaatgacggatgagcagataaaagatgatatgccgtttgatgaatacgggattgactcaatactctttgcggaattggttcaatcattgcaaaaacggatcagcatcaagttaacaccgtccttaatgcttcaatatcaaacgattacagaaatggttgactatttcgcagcgcatcatgaagccgattttgtgacaaaagaaaatggtttcgttcaagacggggacgttcagcctgatgtaaccgccgccgctgaagagagaacatccatgaagccgaaagcggataccgaagacgatattgccgtcgtcggcatctcctgccgttttccgggggcgggcggaacggatgctttttgggagctgctgatgaaagggaatactgccatccggcctgtccccgcatcgcgctggcatgcaacagcaaatgcaaaggattatgcggggtggattgatgatatcgacatgtttgatgcgggttttttcggcatctctgaaaaagacgcggcaattatggacccgcaggcgcggatcatattagaagaagcggttcattccgtttatgatgccgggtacggccaaaaggatttgtcgggccggaaagtcggcgtgtacatcggcggcagggcgcagccttcagccggtatggaacatatcctgcaggcgcctaacccgattttgggggcggggcaaaactatttggcggccaacatttcacgatttttgaatgtcacagggccgagccttgtcgtggatacagcatgttcctcagggctgatcgggctgtcctttgcaaaagacgcccttttggccggaaggattgacgcggccttagtcggttcggtgagtctgctcttatctccgtccgcgcaccggttattcggagcgcgccatattttaaatgagaacggcgtgtttcatatattcgaccgtgaatcagcgggagaagtgctcggagaaggagcgggggcggtttttatcaagcgattgagcgatgcggtgcgggacggagaccgcatttacggcgtcataaaagccgtctcggtaaacaatgacggccggacgctcggtcccggttcaccgaatataagagcgcagagagatgtcattcaaactgcgcttaatatggcggaaaagtcgcctgaagacattggatatatagaagtgaacggaggcggttccccaatcgttgattcggtggaaatcaaggcgctctcagatgtctatcagctgaaccggaaaacgcttctgccctgccggatcggatcggtgaaaccgaatgtagggcatttgcttctgtcttcaggtcttgcgggcttcatccgatgtgtgctgagcgtctatcataagcggattccgcctttcttatcagcgcgtgacccatttgaacattatgactttgaagcgtcgcgtattcattttaatcgtgaacccgttgattggcattcagagaagaaaccccgcgtcgcagctcagagttcatttcctgacggcgggacaaatgctcatatcctcgttgaagaatacagaggtgaaagacagcgggaacatcaccggtcgcctcagccgccggaattcagaaaaaaacactacccgctcttgggcggctggaacagcacggaaagtgaaccggaaaaaacaagtaatgaaaaaacggacattgcggatcttttaaagaaatatgagaaaaaagcagagacaagcactgcacctgcagactcgttttggcaggtgacaacgtgacgtttttaaaaggggactaaccatgaaaaaaacagtgaatctgcgcctgacggcagagcatcccattatgaaaaaccatcttgttcacggagaatctgtcatgcccggtctggcctatattgatatgctgtatcagctggcaaagcaaagccttgatctttcattccgttccatctgtctgaaacgggtgaccatttatcatcctttatcagtgaagcggtcagagcggcttgatgtgagtgtcatattcagtaaagaaaaggagttctggactgcctcgatttgcggggcggattccgggacggttttcttatccgcggagatgcatgaagaagtcttctcatcagacaggcgtcttgacgcaggggagaaaaaacaacaagccgcacttccatcagtctccttgcatgcggtttacgaagccgcgagaagccgcggactgtcgcatgacgggctgatgaagccggagggagagatctatgcttatgaagaggcatgtttccttgatattcggcagtctgattcatgccgggaaaatctccccggcgctctctttcatcccgcgctgatggacggtgccgccatggcctccggcgtattgcagacagctgcaggcgccgagttgtttttaccgatttattatgagtcgtttattgccgctgagactgttacggagcgctgttacgcggtgatttcgaaaaagtccggcacgccttctgaaatggtgaaaatggatattgacttttacaacctcagcggtgcgcatattgcttcactgctcggcctgacagccaaaaaggtgcggacagaccggcagctcacaccaggcgttcagcagatggaggaaaccttataccgcattttctcgacatacgtaggccgtccagtcacaagaaatgatgcgcacaccgtgttttttgaattaggtcttgaatcgtcacagcttctggccattattaaagacatcgaaggggcgtttgatctgcgtctgaatccgactcttttatttgagtgcagcagcatgtccgaactgctcgaagacataaaaacaaaaggaacagatgaatcttccggccttgtcgcggatgcagcaccggtctctgaaacacaatcaggcagtcagacatttactttctatgaacatgaagcattccttcaggatcatctggttttcggcaaaccggcactgatgggcgtagtgtatccgtgtctggtgcttgaagcctccggagcgtctcattccggcacgcatcccgccgagctgaaagatatccgctttacgggcgggcctgtcacgctggagcctggagaggccgcgcagattgacatttcatttgcggcagaaaagagtgccgaacgctttaccgcaagctgcactgtctccggtaaagaaagccggaagacatgtgccgaaggagaaataaatagatatacagaggcacccataaaaaaatcatatgacgttgagcaaatgaagtcgcatgcacaaaaggtggcgccggatgtcatttcccgtctgtacgattcggttgccgacttcacgataggcccgatgctgaaaacggtaacagcgggatacaaaatgagtgagagctcctttttattgcagctggacttatcaggaaaaaaagaaaaaggcgatctgcatcactttgcatttgacccgcttatattgaattcatgttatatgtcgctcggtgaagaagaattgcagctgaaaaagcggattcacgtcccgctcatgattgagaggctgacgctttacggacctgtcatgtctgataccgtctatgtggtgaatacaatcaaacataaaaaagacgggtttctctcatttgatgccgcaatcctcagtcataccggggaacagctggcggaattgaaaaatgcgtctgtgaaagaagtgcttcagccaaatcggcttgaaaatgcgtcttttgccccgtccgggaatcaaagccgtcaggaaacgaaaggaaaaccgctggatattgccattgtcgggatttccggcaagtatccgcaggccgatgatatcgatgcgttttgggataatctcaaacaaggcaaggattgtattaccgaaattccgaaagaccgctggaaatgggaacattacttttccgaggaccgtacggcgccgggagcgatctacagcaaatggggcgggttcattgacgggatcgccgattttgatcctgagttttttaagatttccccccgggaagcggaacaccttgatccccaggagcggctgtttttaatgcatgcttggatggccatggaggatgcgggatatacgaggacatcacctgaactggggcgtcaggtaggcgtgtatgccggtgtcatgtatcaggaatacccgctattcgcggctgaagcgggagtgaaaggacggcatatcgggctccccggcgggatttcatccattgctaaccgtgtctcctatttttgtgactttcaagggccgagcatttcggtcgatacgatgtgttcgggttcgctgacttcattgtacatggcgtgccgggatctgcgggatcatcggattcgcgcggcgcttgccggcggagtgaatctcaccgttcatcctaacaagtacttcatgctgagccaggggcagttcatctcatctaaaggacactgcgggagtttcggcgccgggggtgacggctatattccggcagaaggggtcggggtgctgcttcttaaacgtttagaagacgccgtacaagacggagatcggatttacggcgtcattaaaggagctgccattaatcacggcgggagagcgagcggttacaccgtaccgaaccccaaggcgcaaagcgaagtcatttctcaagctttacaggaagcgggggtatctccgggccggatcagctatgtggaagcgcacgggacagggacgaaattaggcgatccgattgaaatccgggctttaaccgatgcattcggtgatgttcctgaaacatgtcttgtcgggtctgtcaaatcaaatatcggacatggggaatcggcagcaggcatcgccgcagttacaaaagtgctgctgcagatgaagcacaaacaaatcgccccatccttgcatgctgatgttttaaatccgaatattcaatttgatgaagggccgttttccgtctgccgtgaattaacagattggaaacggatttcagcagacggagaagaacagccgctcagggcgggaatcagcagctttggtgcgggcggttctaacgcgcatatcattattgaagaatatgaggctcctgtcaaacaagcaatcagcagccaagagccggcggtcattctgctgtctgcgaaaaatggcgagcgtctgacagaatatgcggagcgccttcttgcttttcttcaaaagaagcatattgataagccggacttatttgatgtcgcgtacactttacaagcggggcgcgaagcgatggatgagcggctggctctcattgcggactcccttaaggagctggaggacaagctcagatcgtacttggaaaatgaaaacgcaccgcatctttacaggggacgggcgaagcgaaatcacgagacagtggctgtgtttgaatctgatgaagatttgcaggaagccatggttaaatggctgaaaaagagaaagtacggtcatttgctgaaaatgtgggtgcaaggagttgatgtggactggaacttgttatattcgggacaaaaaccccggagaatcagtcttcccgcctatccgtttgcaaaagtcagatgctggattcaagatgaagccgaggcggtttcaaaaagggatgacggcaaaacggtgatccatccgctgctccatgaaaacacatccgatctttgggagctgaaattcacctctgtttttaccggacgggaattctttttcactgatcactcagtcaatggacagaaggtgctcccgggagccgccgtgatcgaaatggccagagcggccgttgagcgtgccgcatacgctgtgccggacggacgtaaaggaatgtatttgaaagatctcatatggatgaggcctgtcattcataaagggacggatgtagaagtccatatcagccttattcttaaggaaaatgaagacattgaatttacgatttacagcctatcggaagaacctgggggagaacggattttatacagtaaaggcaccgccgtatcgggagagatagcagcggctccgtctgttcatttagagggctggctgtccggctgcagccaatcggttatgacgtctgatgaggtttatcaggctttccggcatgcgggtatgatctacgggccgagccatcaaggcattgatcagctgatgatcggagagaggggggctgcagcccggctgtcgctgccggaaacggcagacagtaccgccgatcagtttgtcatccatccgagtcttctggatgccgcgtttcaggcgtcactgggtgccggttcagatactgccggagacactccgatgctgccgttttccctgcggcaggcagaaatatttcagccgactcagaaaacgatgtgggcgcttgtccgcaaacagagcgatcggtcagataacggagcgctgacgctggatattgatttatgtgatgaaaacggcgctgtttgtatgagattgacgggcttctcctgccgggctgtccggcagacaaaccaaaccgaaagcaaacggcaggaagttcagacggcgatgcttgcccctgtttgggacaaaactttcttttccctggaagaaaatcgagcggttgatcaggaacaattgctgatcatcggaaagccgggaaataccataaaggccgcggcaaaaatgtggccccgcgcccatctggcggagacgccggatcattcaagcgagcaaacattacgtgaattgacagccggttatcaagatatccgccatttcttatggattgcgccggatcgtttcgcacccgcatccgccagtcaggaaatgcttgatgagcaggagaatggggtgattcaatgtttccgtttcatcaaagcgctgctgtcactcgggtatggaaaccgaaacatcagctttacggcggtcacccggcagacacagtccgtgtatccgggtgatctcccgcagcctgagcatgcaggcgtacacggtttgatcggttcattggcaaaagaatatccgaactgggacatcaggctgattgatgcagaagaaggcagtgattcgtctgagatgaaaaacatctggcgccttcctccagatccggacggaaatgctgccgcgtaccgtaacggagcttggcacaagcaaaaaacagtccgggtgctgacaagttccgctccgcgtatgtcgtacagagaaggcggcgtttatgctgtcatcggcggagcgggcggcatcggagaagcatggagcaaatacatgatcacccgttacaaagcacggatgatatggatcggcaggcggccgaaggatcaggagattcagagcaaaatagacaggctggccctatcaggccccgcgccgcattatatacaggctgatgctcaagatgccgcagcgcttaaagcggccgtccgttccataagagagcgatacggcaatataacgggagtcatccattccgcgataacgcttgccgacaaaagtatggcgaatatggatgaagcttctttcagaaacgctttttcagctaaggtgaatacgagcgtccgaatgatcgaagcttttaagggagaaccgcttgattttgtgctgtttttctcatccgttaattctttcacaaaaaatgccgggcaaagcaactatgcggcagggtgtacatttcaagacgcctttgcccgccatatcgcttccttgcttgattgtgaagtgaaagtcatgaattggggatattggggcagtctgggcgttgtatcagacccgtcttacagaaaacggatggaggcgtcagggatcggttctattgaacccgatgaagcaatggaggcgctggaagtcttactatcagaaccgttcagccaagcggcattcatcaaagctgctccgcacggcttagccgcactgacggatcaagatgcaatatcggttgtatccggcccggagccttcatttatggaaagcgtcaagcggcaaaatccggatcggaatgaacggcttgagactttaaaacgagaaatggagttgcgcatatgaacagccttctttgcaaactgctcttttatcaattacagtcaatcgggtttttcagcgagcctgtcaccacacctgcagcatccatgcggagcgccggcgtgatcggcacatacggcagatggctggaagaaagcctgaatctattaaaagaaaacggatatatcgcgtatgacggatacacgatcactcttctcgcggatcagcgcccggacggccgcacagtctggaatgagtggaatgcccataaacgcctgcttcccaagggggagcttgcgcaagctgaattggccgaggcgacgataaaagcgatgccttcaattttaaaaggagaacgtccggctacggatatcgtatttcccgattcatcaatgcggctcgttgaaggtgtttataagcataatcccgttgcggattattttaatgaagtgttagcagattccgcggccgcttacctgaaagcctaccttacagaacatcccgatgcccgtatcaggctgatagaagtaggggccgggacgggcggaacgagcgccatgctgtttacaaaactgaaaccatttgcaaaacagattgcggaatattgttatacggatgtttctaaagcttttttaatgcatgccgaacaggaatacggacctgacgtgccgtatttgacaacagccttgtttaatgcagaggagccttgcgaatcacaaaatatcaaaacgggtgtttacgatattgtcatcgccgccaatgtgcttcacgccacaaaaaatatcggtttgacgctgcgccgtctgaaagcgctcctgaaatacaacgggatgattttgataaacgaaatcagcgatcgttctgtttttacccatttaaccttcgggctgcttgacggctggtggtcctatgaggatgctgagcttcggattccgggaagtcccggcctatatccaaaatcgtgggagcgtgtgctgcattcggaaggatacagagcggtttgtttccctgctgaaacggctcatgatttaggtcagcagattatcgcagctgagagtgacggactcgttcggatgcaagggatcagagacggcagaaagccatacgccgccccggccgaagttttccgaaagcccgcacagcctgtttcccgcagccgcgcgccagaggagcatcaagctgttaaggctgatggggaatcggtcgcttcccatgtccgctctgtcatcaaaacaagtattgccgatgtattaaaaatgaaagaagaggatattcaggaagaactgaatttctctgaatacggcattgattccattttggccgtcaatgtgattaacgagattaataagcgattgaatcttacactgcagacaacgattttatttgattactatcatgtgaaactgctgaccggttatatctcggcagaatatgaaaccatcatagcctcatctctgaagaccgaaagagcgaaaatccgcccggcgcttcaggaagaacggcctgctgaaaaacctttgaagacggatagaaaggaaaacggttatcagaaaccgaaacaagaacgtatgccgctttctttcgcaaagtccgatgactcgggaatgttccgggttgtgattgaccgtccgggcggcattgaagatctgacgattgcccgcagtgaagtgcccgagacaaaagatgacgaagttcaaatagccgtccgcgccttttctttgaacttcggagacttgctttgtgtcagagggctgtatccgacgatgccgccttatccgttcactccgggattcgaagcaagcggcgtcgtgatcaagacagggaggcatgtaacatccgtcattccgggtgatgaagtgattgtcggcatgggagaggaatttggctctcaggcgaatctcatcacatgtaaagaacatcaagtctatcataaaccggcccggctgacctttgaagaagcatgcgctcttcctaccgtggcggtgacaatgatagacgccttccggaaagccggacttaaaaaaggcgaaaaaatattaattcagaccgcgacgggaggaacggggctgatcgcggtgcaaatggcccggcatatcggcgcggaaatatatgcaacggccggatcacagaaaaaaattgagtatctgcattcgctcgggatccacaataccatttgctatttggaagaagattttgaaacggaaatcatgcgaatgaccggcggccggggggtggatgttgtcattaataccctggccggtgatgccatgcaaaaaggaatgaattgcctggcgccgggcggaagatatatcgaaattgccatgactgcgctgaaatccgctaaatcagtcgacttgtccgtccttcataacaatcaatcgtttcacagcgtggatttgcggaagctgtcccttcaaaatccggatcaggtcaaggactatcaattggaactgcagcggctggcggaagagggagtcattcagcctgtcatctcaaaaatcttttcctttgaagacataaaagaagcgtatcactgtctggatgaccgcggaaatatcgggaaaatcgtcatcagcgtttctgagccgtatcaaatgacgtaccgccccgaacaaaaggatccggccgaaacggtaaaatcagaagctgtgttacctgaaaaagaaccgatcgcgattatcgggatgagcgggcggtttgctgaatcggagaatgtccatgagttttgggaaaacttagccgccggacgggatctgattaaaaaagcagacagatgggatgtctctgacagtcaatgccagtatggcagttttatagagggcattgaatgttttgatcccgttttctttcatatatcgggacgtgaagcaacctatatggacccgcagcagaggctgtttctggaagaatcatggaaagcgcttgaagatgcgggatatgcgggagacttggtaagaggccgggaatgcggcgtgtatgccggctcctgcggcggagattaccaggccatttttaaacagcaggggcccgcgcaggctttttggggcaatcacaattccgtcactccggcaaggatcgcctatcaccttaatttacaagggccggcgatcactgttgatacagcatgttccagttcgttgacagccattcatttggcatgtcaggggctctggacgaaagaaaccgaaatggcggtggcgggcggggttttcattcaatccactcccgctttttatcagtcgtcaaataaggcgaatatgctgtcaccgaccgggcgctgccatacgtttgatcaaagcgcggacggcttcgtgccgggtgaaggcgtgggagcggtggtgctgaaacgtcttagcgacgccgtcagtgacggagatcatgtgtacggcgtcataaaaggctctgcaatgaatcaggacggcgctacaaacggaataaccgctccaagcgcgctttctcaagaacgattggaacggcatgtctatgatacttttcacattaatccggaaaccattcaaatggtggaagctcacggaacgggcactgcactgggcgacccgatcgaattcagcgccttaacgtgcgctttccgccgctatacggataaaaaaggatattgcgccatcggctctgtgaaaaccaatctcggacatgccgctgcggccgcggggatggccgggctgtttaaaatcctgctgtcgctgaagcatcggcagattccggcttccctgcattttcatcaagccaatcagcatattcaatttgcggacagcccgttttttgtgaatgaaaagctgataccgtgggaacggaattcggatgcaccgcgcagagccgcgatcagttcattcggattcagcggaacaaatgcccatcttgttattgaagaggcgccgcaaaccgtgcgccggtcaccggcaaaaccggcctgcctcatccctttatctgcgcggacggagcgtcagctggaaattcaggcagaacgcctgctggattcactcagcaagaacaaagacagcgatctgggaaatataagttatacgctcctgctcggcagaaagcatctgcatcaccggtttgcctgtatcgtaagcagtgcggacgaactgaagcgggtattatcggagtggcttgtaaaaagagagcttccgggtgtgtttgtgtccaatttgaaggaccagaagccggcagacgaagccggaatgaaaacattcggaatggaatgcattgaacagtgccgctcggcggcttcacccgcacagtacagagaaagcctggcacatatcgctgaccttttttgcagaggatatgatcttcctttcacacggatttttgacggagggcaatattataaaacgccgcttcctgcctatccgtttttaaaagaaaggtattgggcggctgatgtaaacagttctttaccaggccaagccatgaaaaagtctgaaacgcaaaccgttcccccgtctccgccacagcctgaacatgaaggtctgatttctctgagtcctttaactgagatcgaaatgacagcgtttgaaccggagacattgcaaaaaccgatcgtcttacagcctttggattgtactgtttctgtccagcagccggaaaacgccgtttccgaagacaatagaacattgcttgaagaattgaggataagcctggcagatattttatttttgtcaccggaagatattgatgctgatgagcctttcatcgacatggggcttgactccattatcggggttgaatggatacaaacagtaaataaaacgtaccacactgagattactgccaataaggtgtatgaacacccgacgcttgaggagcttgcggaatatatagcgggacaaataaagaaacccgagtatgctgaagcggaggaaacagcggtacgtccgcaaatcccggaagcagaaattctccttgccggcatctctgacggcactttgcgcaaagagcttaaagaaagccttgcggacatcctgtttctgaagccggaagatattgatgagcatgaggcattcattgacatggggctggattctattatcggtgtggaatgggttcagtctattaataaaacgtatcaagcgtctattacggcaaatctggtctatgaatatccgacaatcgcaaaattagccgggtatctgaccggttctgtccaaaaagacactgaggaagtacatgaggaacatacgaaacaaaacgatatatcagaagagacagatgatcaagaaccgcccgaactgatctgtcttaacccggggggaaagggaagaccgattttctggtttcattccgcgctgggggcagtggagctgtaccagcctgttgccgaacggaccgggcgtcctttttacggaattcaggcaagaggatggatgacagaccgggaaccgatccgcggcattaaaaacatgggggaatattacgttaagctcatacgtaccgtgcagccccggggtccttacgatgtaggcggctattcattagggggcatgctcgcttatgaagtcacccggcaattgcagctggctggagaaaccgttgagtcaatcgtcatgctcgactcctttgactcggcgggtgcgcgggaaataaacattcctgatgaattatttgataaaaatatgatgctgcagacggtgaacatggctttatttgcaccgatctatcaacatccggaacgcatttctgaaaccttgattcaccgtgatgaactagatgccgatcttcatgaagacatatttttagagcaattaatagcaaaagccaaacagcgggggttaacgaagacggacgcgttggtgaaaaatctgatcaggcagaatataaacgttcaggacgcttacgaaatcactgattacgaactcctgccgcttccggatccgaacggggtgacatgctattatttccgaaataaaaacggtattttcttgggtgagcttgatccgtattttacgatcagggccgatattttatccgctgatttcgtcaactactggagccagtggcaagagcatatgacaaacatcgccatcatggatgtggcggtatccaaccatatgacgttattggctgaagacagcgcagtcgaaacgatttctgaattttgcggcgttttatattcggcagacggaatgacagaacacagctttctgaaactgcaggaaaagatactgaacgtgcatggtgagatgctgaagcagcccgccaaaataagaccgtaaattcacatatccgcccgccgggtttactcgtaagctttggcgggtcatttcaaatcttggacacatcttggaggaatgaaaatgaccagtttaacaaaaatcagacagcagcagccgtacaagtggtaccaaacgatgagagaaacctctcccgttcattacaatgaaaaggaagattgctgggaaatcttcacctatgatgaagtgaagcgggtgatttctgactacagtcatttttcttccgatcataaatacttaagtgcggacaagcaggaaaaaatgatccggcatattaacaaagacagccttttgaaaatggacccgcctgaacacaccgtcttcagaaaattggtcaatcagccgttcatgccgaaatcggttgagtctcttgcaccgcgtatagccgcgatcgctgatgacctgcttcaggccgtccgttcaaaaggcaggatggacattattgaagattacgcatttccgcttccgattatcgtgatcgcagagcttttaggatttcctccgaaagacagggatatctttaaaagctgggtcgaccaaagccagaatgtaaaagatgaaaagaaaatgaatgaagtgcaaaagcagatgatcggatactttatgcagtttattttacagcggagaaaacagccgcaaaatgatttaatcagccatttaatttcagctgatttagacggagagccgctgtcagacaagcaattaatcggtttttgcggcttgttgatcgtcgcggggcacgtaacgacggaaaatgtgatcggaaattcatttctcagtctcaaggagttcccgcatattctgccccggctgcttgaaaataaggcgctccttcctgactttattgaggaagtcatccgcctcagaccttccattcagcgggtaacccgctacaccgcggttgagagcgagattggcggaaaaacgattccggccggagaaaaagtatatgcgtggattggatcggcgaacagagatgaaaagaagtttgaaaatcccgatcagattgacttgggacgaaagccgaatcagcacctgtcattcggtcagggcagccattattgcttaggagcgccgctggcccggcttgaagcgaaaatcgcgctttcccacttttttgaacagatgcccgcatggcgttttactgaggatcaagagccgaatctggttccgagccctgtatttcacggcgttgacaggctgcttgttgagttttgaacgaaaaaataaaagaggcttcacgggaagcctctttactctgggggcttggagaaatgaatgtaggaatcgaagcaatgaacgtgtttggcggaaccgcgtatgtagacgtcatggagcttgcggaacatcggaacctggataaaaaaaggtttgagaacctgctgatgaaagaaaaagtggtggcgcttccgtttgaagatccgattacgttcgccgtaaatgccgcaaaaccgattatcgattctctgtcagatgaggaacggaatcagattgaaatggtcattacctgtacggaatccgggattgattttggcaaatccatcagtacctatgtccatgattatttgcagctgaagcggaattgccggttatttgaggtgaagcaggcttgctattctttaacggccgggtttcaaatgggcgtgaatttcatcttgtcgcaaacatcgccgggagcgaaagcgctcatcatcggaacggatatttcccgctttttagtggctgaaggcggtgacgcgttgacggaggaatggtcctatgccgaaccgagtgcgggggcgggagctgtcgcgcttttagtcagcagcacccctcatgtctttttgcttgatcaaggtgcaagcgggtattacgggtatgaagtcatggatacctgccgcccgattccggatagtgaagcgggggatgctgatctgtcgctcatgtcttatttggattgctgtgaaaattcatttcaggaataccgaaagcgtgtgagcggggcggattataagaatacatttcaatacctttcttttcatactccgtttggcggaatggtaaaaggagcgcatcggacgatgatgagaaaattggcaaaggctaagccgcaggacattgaagcggattttcagcaacgcgtgctgcctgggattcaatactgtcagcgcgtcggcaacatcatgggggccaccgtatttttatctcttgccagcacgattgataacggctcttttgaaacgccgaaacgcgtcggctgtttttcatacggttcgggctgctgctctgaattttacagcggtgtcgttatgccgcaaagccgtgcgcggcagaatcaatttcagatcagccggcatttggatgaacgcgtccgtttatcgatgactgattatgaccggctgctccaagacagcggcatcgtaaaattcggcacaagaaatgccgcgcccgcagcagacatcccgaatgcgcatcaaggaaaaacgcgattagtgctgactgaaataaaagagtttcacagaaagtatgaatggacgacctagtataagagccggaaaggcttgagtatttttaaagaaacggagaatacacatgaatccaatgattgatgtacaggaaacagaaccgggcattgtgcaggtcacaatgcaggatacggccgggaaaaacgggctgtcagaagagtttgtcagagagctgcaccgggtattccaagacatcaatgcccatccgtcctataaaactgtccttctgacgggttacggaaattatttctgcacgggaggaacgcaggaggggcttttgaccattcagagcggaaagcttcaatttacagatttaaagcttcacagtcttttattggattgcaggatccctgtgatttccgtcatgcaggggcatgcgatcggagccggctttacgatcggtctgagctcggatttcgtcattttaagcagagagagtttttattcttgtaattatatgaagtacggatttacaccgggaatgggcgcgacgtatattgtgcctgaaaaactgggaattgtcctcggggaagaaatgctgtttacggccgcgaatttcagcggcgccgctctggaaaaacggggtgttccgtttgaagtgctgccgaaaaaagacgcccttcaaagaggccgcgaattggcccggctgctggcggataaaccgagagcttcactggttgcgctgaaaaccaatgtgaccgcacggatcaaaagagagctgacaaaagcggttgaggaagaggtaaacatgcacgaagccacattccatcttcctgaagtaaaagagagaatcagccgcttatacggcagttaaacagaatgaaaaaagcatgggatgccccatgctttatgactggtccgtcttttgcagaacggagcctgcgaattgttctttaatttcggcgctccgggctgcggtttttgcgatgcagtgcatgatggcttcttcaaagcggcgctcgtctaatgcgcgaaggcctgcttcagtcgtgccgcccgggcttgtgatttccttgcgcaggcgttcaggccgtttgctgcttgttctgagcatttccgtcgccccggccatggtttgtaaaatcagctcttttgccgtttcttccggcaggccggcttgaagggcggccttttccatcgcttccacataccggtacacataggcgggaccgcttccggcaatggctgtgacggcatcaaggtgtttttcttcaaagagcgtcgcttctccgattgtttccagaagctcttttgccgtccggatttcagcttcactcgcctcagagcttgcggaaaaaccggtcgccgattgctgaatggccgcggatgtattcggcatcgcccggatgatggtgagctttctgccgaaatattgctgaatcgtgtgaatcgtcagccccgcgatgacagaaatcacaagctgatctttcacgtattcgcgaatgttctcaatgctttctgccgcatctttcggtttaaaggcgagaacaataatgtcggtattgctgaaaaactcttctttatcccggcacggtttcactccgtacgttttttggagctcttcaagccggctgtcatttgaccggtttgtcatatatatatgtccgggggctgtcattccgctttgcagcagtccgttcaccattgcttccgccattgatccggccccgataaaaccgattttcttcatataaatcctccttcttctaaaacacaaaaaaaccttcccgtcaaaaaggacgaaaaggtttcgcggtaccaccttacattagcacgaatcagccgtgctcagctcaaatcccgtaacgagggatacgtttaggttttcctaaccgctctgagggcaggttctgtaaacaagagggccgcaatgtctttcagccggggacattgctctctgctgccgttgtttatatactagttcctcgtcatcgcgttccgtgttttctagtttgttgttcattatgctatgcgaaagagcgggatgtcaatctttttttccgatatgcggcaataatgacacagtgaaaagaaaacgctaaaatatgattattcaggaatgaaaagaacgaaggagcgtaaacatggcagcgagaaagatcattccgatacgtgtgccgactccgtttgcagtcggcgacgttatcgtttatttaataaaagatgaagccttaacccttattgactgcggcccgaatacaaaggaagcggctgaatcgctctcatttcagcttaaggaacacggcgtttctgcggcggatatagaacaggtggtgctcactcatcatcacgcagatcattcaggtctgctgcaccttttttccgaggatacggaagtgatcgggcatccgctgaatgacaggtacattactcaggatcagtcgtatatcgcccggcaggaggacttttttctgtcgcttatgactgaaatgggcgttcccctgacgcctgaagacatacagaaaacagttaagctgtcgtacttattttctgcaaaccgtccgttaacgaaaacagtggaagaaggcgggaaaatcgacgggcttaacggctggacggtgctcgaaatcccgggtcatgccgcttctcacattgcgctctaccatgaaaaaagcggtgaaatgttcagcggcgatctgcttttgtccaacagctccaccaatccgattctggaagctccggaaaaggggggcgtgcgcgcggccccgatgctcgactacttgaactcaatgaagcggctgtatgacgtaaacccgtcccttttatatccgggacacggcgatctgctgacggacgtaaagcctgcttttggcaggcggcttgaaaaacagagaaaccggtcggaatatgtgctgcgcctgttgtcagaggaaacgctgacggctttccaggtatgccggcggctgtttccggctgtgtatgaaaatgaattgtttttaacgatgtcagaaacgatcggccatcttgacgtactggctgcaaaaggggaggctgaatcctttcagtcgggaaatactctgatgtttaaagctgtgaaggggtgaaggaaatgggcagattaacggataagcggatttggatcaccggagcatccggcggactcggagaacggcttgcatattcctgcgcggcagaaggtgctcatgtttttttatccgccaggcggggggaccgcttgcaggaagtgaaaaaaacgattaccgcgcgcggcggacggtgtgatgtcattccgtttgacgtccggcatgcagaagaggctgaaaacgtaaggcgtttgatcggtcatgttgacgtattaatcaacaacgccggcttcggtatttttgaaacggccgctgattcatctttggaggatatgaaggcgatgtttgaagtgaacgtcttcggattaatcgcctgtacgaaggcctgtcttccggtgatgcttcatgcgaaaagcggccatattatcaatatcgcctcacaggccggcaaattggcgacgccgaaatcaagcctttattccgctacgaaacacgccgttttagggtattccaatgcgctgcggcttgagctggccggtacgggtgtagctgtgacaacggttaatcccggtccgatcaaaacagacttctttacaattgcagataaagagggcggttatgtgaaaagcgtcggcagatggatgcttgatgccgaccgtgtggcagagcgtattacatccgtaattctgacggataaacgggaaatgaatcttccgcgatggatgagcctcgggacgaagctgtatcagcttttcccttcgtttacagaaaaactggccggccgcgcattaaagaaaaagtaacaagggggagaaaggaatgtccgacctggatatacacaaggcattgatgacagagcctttagtcaggcaaatggcggaggcgcgtgaagtattttggatcaacccgcataaaaccgatgatccagtaaagaatggcgctgaatggagaaaggagattgccgaagcggaagaaaggctgcgccggtttgcgccttatatcgcgtcggcttttccggagacggaagcggcgggaggcctcattgagtctccgcttgtcttcatcaatgaaatgaaaaagcgtctggaacaaagcgccgctcaggctttccccgggcgtctgcttttgaaatgcgacaatgaacttccgatttccggttctattaaagcgcgcggcgggatttatgaagtgctgaagcatgctgaagatctcgctttaaaagcgggaatgctctcaacagacgatgattacagcatattgactgaggaacggtttaccgcttttttctcaaaatactctatagccgtcggttctacgggcaatttaggtctgagtatcggcataatcggcgcgaagctcggcttttgtgtgaccgttcatatgtccagtgacgcaaagcagtggaaaaaggagctgctccgggaaaagggggttcgcgtcatcgaatatgaagcagactacagtctggctgtcaaagaggggcgcatgcaggcgaagcaggacccttattgttattttattgatgatgagcattcccgggatctgtttctggggtatgccgttgcgggaagccgtgtgaaaaagcagctcgatcaaatgaacataaagccgggtgcagatgaaccgcttttcgtttatttgccgtgcggggtcggaggaggcccgggcggcgtcgcgcttgcgctaaagctgatctatggcgagcatgtccatatttttttcggtgagccgacgcattcaccgtgtatgctgttaggactgttttccggcttgcatgacggaatcggcgtgcaggatatcggccttgataatcaaacagccgccgacggacttgcggtaggaaggccgtccggactggccggccctctgatggagcctatactcagcggctgttatacggctgatgacggcacgcttttttcgctgctttatcaattaagagcggccgagaataagagccttgaaccctctgcactcgccggtatggccggagccgtcaagttcgttcagaccgaagccggtaaccgttatataaaagagcgggggcttgagatgaaaaatgccgtgcaccttgtgtggagcaccggcggaagcatggttcccaaggaggaaatggaagagtacagccggatcggttcctcatttgtgaaaaaaatgggcagacagtgaggcggttttccgttacaatctttgtaagcgtttgttttttaatcggaaagccatacagagagattggtgtgaattgtgaaaagtaaagaattgaacttacatacattgtatacgcagcacagccgcgagtcgtgggccggattcggcggccatctttccattgccgtttcggaggaagaagccaaggccgtagaggggctgaatgactacctgtcggtggaagaagtagaaacgatttatattccgcttgtgcgcctgctccatcttcatgtcacgtctgccgcaagacggaatcagcatgtcaacgtgtttctgaaacatccgcattcagcgaaaatcccgtttatcatcggaatcgcgggcagcgtcgccgtcggcaaaagcacgacggcgagaattttgcaaaagcttctttcccgtctgccggacaggccgaaggtgagcctggtgacaaccgacggtttcttgtatccgacggcggaattaaaaaggaaaaaccttctgtccagaaagggattcccggaaagctacgacgtgaaagcgctgcttgagtttctgaacgatataaagtcagggaaagagagagtggaggcgcccgtatactcccaccttacctatgacagggaagagggcgccgtcgaggttgtcgaaggtgcggatatcgttattatcgaaggaatcaatgtcctgcagtcgccgaccttagaggacgacagggaagatccgcggatttttgtatcggatttctttgatttttcgatctatgtggatgccgaagaaagccggattttcacgtggtatttggagcgtttccgcctcttaagagaaaccgcttttcaagatccggcttcttattttcataaatttaaggatttgtctgatgcagaagcggataccatggccgcctccatttgggagagcgtcaaccgtccgaatctgtatgaaaatatcctgccgacaaaattcagatcggatttgattttgaggaaaggtgacggccataaagttgaagaggtgctggtaaggcgggtgtgatgtgaggaggaagcgaatattatgatgcatcatattgaattgtatgtatctgacttgaaagcctccgcccggttttggggatggtttttaggtgagctcggttatagggagtttcaaaattgggacgccggcatcagctggaaaaacgcaggattttatgttgtgcttgtacagacagaggagcgttttttaacaccggagtaccacagatgccgggtcgggctgaaccatctggcttttcatgctgcgtcaagagagcaggttgacgagatgacggaaaagctgcttgccagaggatgccccgtgctttacagggaccgccatccatatgcaggcggaagcacgcattacgccgtatacacggaggacccggatcggataaaggtggagctggctgcgcctgcttctgaatgaactataacttctcgtttttttcttcgcgcagcgcgtcgagtttcttttcgattctgtccaattgtatgcggcgctgcttcaagcttttgaatacgtatatcacggcaagcaggaaaaatgcggctgcaataaatgaaatcaattgaaaaatgacatcaccgatgttcatcttttttacctccgtgtgcggcgggcttcttcagcccgccgttttttcattttaaccaatgtgaagacatgggggatgaatcatttctctcctagctttgtttttttctgagaatgaatagtttctcatgtggcttatgaccacttttgcggccgcatatcccggaatggccaacagcatcccggcaattcctgagaatttgccggcggcaagcagaagaaaaataatggtcagcgggtgaatgtccagcttccgtcccataatttgcggggaaatcagctggctttcaagctgctggacaatgacgacgaccgtaatcaccagcaccgcctcggtcggtgaatcgaacaatccgacaatgactccgggaaatgtgccgatccaaggcccgataaacggaatcagatttgtcaccatggcgaacgcgcccagaacgagcggataatcgagcccgatgataaaatagccgattgtgacgagaacgccgacacagaaactgacgagcagctgtccttgtatgtatgaactgagagcttcatccatgtcccgaaggatttgttttccttctttttgatgtttttccggaagaagccgcagcagtcgccggggggctttatttccttcttttaacatgtaatacagcgcaaacggaataatggctgcggtgatgacggcattggcagccgtaccggccagactgctgagagaatcagcgattgaaccggaataatttgcggctttgtccgctaattttttaaaggaatccccatgctgaagcctggaaaaccatttgctgtcctgaaggtgtccgatccaattttcagcttttgcggaaagctccggaatatgatctgtgaaggctgtaaactgtttttgaacggcagggcccgccgtatacaggaagaggacaaaaaggccggctgttcccgcataaatcgctaaaatcgcgattccttggggcagctttaatttcgcatgcagcactctgacgagcgggcggcacaaatagtaaaggacgcccgataatacaatgggcggaaacaaggttttaaccgtaatcacaacaggctggaacaaaaagtctattaatgttccaagataaatgatgagaaataacagaagaacggcatagccgatcttgaaataaggcccgacaggcatatcctgcaccacgcaatctttaagggtttactctcggacgtttcccttttcgcccggtgcataaacgtccgtgtcaggaaaactgcccctgattggtgacgtaatcgtagataatatcttctacatgggcatggagatcctcatcgggttcttcattccttctttcttctaaagctttttttaaactctgtttttcataggggctcagcggatctgtcgacacattccgtccatactggcggagggcttgtcccagcattttttctataaattgatccatcatatattctcctattcttgtcattcatctttattctactaaatatcatgtgatcctcccactcttctatcatattttctgtcaggacgatttaggcttttattccagttcagccgagagaataagatgaaacggcagcgttaacgcatcttcatcgtttatgatttttaaacgtttttcgtcatgcctcacttgtttcacccatccccaaaagcggcgggggccgcgtgctgaagcataggtgaccgagatggctctgtcttcttcaatcgacgccgcaatgatgcggttcatgtcgttcagttgctctgcgctcagttccggaggccggaattcccgttcttttcgtttttttgcaagcagctgctcccgatgttcgggcagcatcatccggcttgattcccacatgacattatacccgggtgttaatttgttcggattcatgtatatcacctcaattatttgtaatgcccgccgattttttcagcccggtgaaaggcttggccggcctctgtcagcgaagcggcatggaggagcgacgcagggccgtaccgctcatgaatatcatccaatactttgccgagactgatctttttttcctgagcatcaaacaggctcagctgaacataatcacagggctccagctgggaaagggagacgccggcgctgcggacgggctcaccgttccaatgctctttgaagagcttgaccgccgctttaaaaatatccattccgaaattagtcggagagaccagctttctctgtctgtgaaaacctgaagggaattcaaaatcagcgcctctgatgctgaccgaaaccgtatggccgatgtattgtttgaaacgggcgcggcgggccacttcttcgcttaactccaacagcacgactttgatatcctcaaagcggctgtagtctctcgggagggtcatgttatggccgatcgctttttgccggctgtgcgtgttgacggtgaccggagagggatcgatgccgcgggctgtccgctgaagcaattcgccgttaatgccccagcgttttttcagcagttcggcggggtgcccggcaagcccgccgattgtgctgatgcccatccgtcttaaatgatgctccatccgttttccgatgccgaataattttccgaccggcagcggccacagatcctccctgatatttgacatatccaatctgtggatgccggatgcgttttttttggcaaaatggtcgcaagccattttcgcgagcgccttattcggcccgatgccgacacgggcataaattccgaattcacgcataatcgcttgctgaatgctttcggcaattgtaaaaggatcaccgaacagccgcctgcttccggtcacgtcgagaaactgctcatcgatggagtagggttctacaagatcggtataccgttcaaacagttcggtaatcatgacggatacatcaatataccgctgcatccgcggacggacaataacggcgtcgggacatttggcctgcgcttcccacagccgttcggcattttttacgccgtatcgtttggcgagcggacaagccgcaagcacgacgccgctgcgtctttcgggatctcccgagacaatcacgggccggcttttgagatgaggcgcttccgctttttccacagacgcataaaacgattgcatatcaacaagaagaatatcagccataaaaaaacctccgagaacgtttgttctgtttttcattgtacccgaacaatgatcacgtttatactggtaaatcattccccggctggaagacgtgctgattcgtttgcttgaaaagaaatcatttacaattgcaaacaacccacatataattttttatattccaatgagaagagctgacattcattttgccggacgaaaaggagagtcaatcgataatggatattcgaacaattacctctgaagactatgaaatggttacgtctgttttgaatgaatggtggggcggcaggcagatgaaagacaaactgccgcgcttgttttttgaacattttcaggacacgagctttatcacgtacgggccggagggaatgaccggttttttaatcggttttcagtcacaatcagaccctgagacagcctacattcatttttccggtgtgcatccggatttcagaaaaatgcaaattggaaaacagctctacgatcgatttatggagacggtgaaaaaaaggggctgcacaaaagtcaattgcgtgacggcgcccgtcaataaagtatcaatcgcttatcatacaaaattaggctttgaagttgaaaaaggaaccaaaaccgtaaacggaatccctgtttttgcgaattatgacggtccgggagaagaccggattctgtttgtgaaatatatgtagagggggatgaatatgggttttttagctgacacgcccaaaccgccctattatgcggtcattttttcatcaataaagggaaaatatgatgaggaatatgagcatacggcagagcgcatgatgaatttggcaggcggacagccgggctttttaggcgcggaaagcgttcgggaggaaaacggctgcggcatcacggtttcctactgggacagtctggaggcgattaaaaggtggaaagaccatactgaccaccgggcggcaaaacaaaaaggaaaaagcgcctggtatgaagcgtacgcggtccgcattacgaagacggagtcacagcgaatgtttgcgtcaaaaggggcggaagattgattacatttttacggcatacacaagaacagacggcgcgggaaattgcggcggttcaacgctgctcttatcaaaaagaagccgagctgatcggctttttcggcattccagccctgcatgaaacacccggtgacatacagcggtcacgggagacgtttgccggtttcagagaaaaagatcggcttgcaggcgtcatttcgtatgaaaaaaaaggatatgaccttgtcatatgcaggctgacggtgcacccgtccggctttcggaaaggaatcggacgggcgcttattcaatttgtgatcgaccaaaaccgggacgcccaaaaaatagaggcggctacagccagtcaaaacgttccggcagtctctctctatttaaaaaccggcttcacagaagccggacagacagagacgccggaagggctgaccctctcgttttttcatctttatccgaagaggaaagcggaagttgttccgtacaagccggaatggaaagagatgtttgaaagagagaaggcggacttgatccgaatcttcggccccgcacttcattctgtcagccatatcggcagcacctccatcccgggaatggccgcaaaacccgttatcgatatactggcggaggtcaaagatatttcagatgctgaccgattcagcccgcagctggaagcactcggctatgaggcgcaaggggaaaacgggatagagggccggcgtttctttcaaaaaggcggcagcaagcgcacacaccacgtccacatatacgaaacaggccatccggatgtgaagcgccatctgctgttccgggattacctcactgaaaagcctgaaaaagcggctcaatacatggaactgaaacggcggctcgcaaaggcatacccgtacgatacggcaaagtatagtgaagggaaaaatgactggatcaaggcggctgaacaagaggcaaaggactgggagagcgggctgctgtaaagaaagcagaaacaatgcatacagcggctcggtatgctacaatggcgaaaatgaaaaacggaggatcatctatgcaaatacatgtgacggatgcggcgaaacacacacttcagcagacgatggacgccaacccggggaaaaaagcgcagctccgctatgacgcagaaggctgcgggtgcgcggtgagcggcgtgccgaccatctggctggcggacgaattaacgggacaatgcgaagccattgaaaccaacggacttccgctttacatccagacctcacaaaaagtgttttttgacgaggaaatgacaatcgattacaatgaaaaggcaaaaacgctcgtcttaaaaagcccggcagagatgctgagcccgagaatgagcatattagtaaagcagggagaaacggaaagtgaatcaaaagctgaaagccattaaacagacggcacagcataaaacgtgggtatcctttctgaacaacaaccacccgtacagtctgctgcactggtccatcggaggcgctgaatccgttcagaaggatgtctggctgcttcaggatgagatgaccttcaaagcgcaggagtttacgacaatcgacctcgccattgactggatcggagaaaatatggacgggattaccgacgttttatgacgggaaagcgaaagaaccagcatacgttctttcgcttttttacgtttgcgtcatggtatctaaaaaggtttgaacggctttgcggtagctctccggatttttggtgtacgacatggcatgcccgcccgattcggccagatagagcatcttcggtccgcgttttctgcggtgcagcaattcggaagaagcgggaggtatataatcatcttccttactgtgaataaacagcacgggctgccggattcggctgataaccgatagaggcgatacatcacggatacggtatccttctctcatccgcaaaaagaaatcagccaaaggcagaagcggccacggaggcagccggaactcccgcttcagtctgtaggcgagctgatcgcgaaagcttgcgaacggacagtccgcaatataaaaatcagcgcctttttcatcctgatgcccgcccgcgtataataaggccgtcaccgctcccatcgattccccgtggatgccgatttgaccgccgtctcccgttttgtgtctcacccaattcacggcttcttccaaatcatctttttcaaaatagccgtagctcgtcgttctgccgccgctttttccgtgcccgcggtggtcatatacgagcacattccagcctgaatctaaaaataaatccatgtatttcaatgaattgaacgaatttacggtgacgccgtgacaaataatcatggtgtttgccgtatgatgcggggcgacgtaaaagcctttgatctcatacccgtggcgtgacaggatgacggcctcttctttttccatggcctgaaaggaatcaaatctatcatgcccgtccgccgtttcttttttcatgatatcttcatccgtctttttcttcataaacataatgagattcgtaaaagcgaatccggcagccaaaaagactgcgcaagccgaaccgaacaccgccagccattttttcacacaggcaccctcctttcatatgaaaaatccttcctccggctttttgggaccgtgaacgttgccggccgccggcgctccgtggtacacttgcttcaccatattcagatacggggggtgtaatgatgaaaaagcagctgtctaaagaaaaacacagcttaaaagacgatctgggggaagatctgaaggccaggcttttgcaaatgaaaagtgagctgaaggaagaagacgagaaaaaacaggcgcagcaaaaagcggaacaaatcagaaagcgaaaagaaaaagaaaaacataaaagctttgaagagctgctgaatgaaagcagtctcgattggcacaaatataaataaaccggcatctgacaaggtgccggttttattgtttaagaacgatgggcttcgtatacgtcccgttttgtatggtattgcagggctttgatttcctggctgcttaaacgccgggcctctgcagccgaacaattttctctcagctgctcaagtgagctggctccggtgatgacagaagcgacggccggctgtgacagtaagtattgaagggaaagctccgtcatgctcaagtcaggtgcggcagcgccgatcgcttttttggtttcttccagttctgcaaaagaatatgttaaatagccgttctcttttacgcttgcggctgcttgatcaagcggtttttccgtaagaagccctttagcgacaggccctctggcgactacgctgattccgttctcctctaaaaggggaagccactcctcaggacgccggtccagcaggctgtattgcatcataacgcttgagatatttgatttttttacatattctttaatgacattcggacgaatcgaggaaatgccgtaataccggatgacaccttcctgttttaagtcctcaaacgcttcgatcgtttcgtcaatatgatcttccatcgtgccgccatgcagctgataaaggtcgatatagtccgttttcagccggcgcagactgtttttgaccgcttcttttatgtatcctttggaggcgtcccaatgccagccgtctttatcatcattccagcggtttccggctttcgtggctaaaatgatgtcgtccctgcggtttttgacggcctccccgacaatttcctcatttctgccgaaatcataaagatcagcggtatctaaataattgattccgagctcgatcgcttcatccaaaatagacagcgcttcagctttatccgtgcccagcgacatacagccgagcccgatttcgcttatttctaaatcagaatgtcccagtgtgcgttttctcatcgtttcgctcctttttatagtcttttattgaccgtaatataaaggcgcgaagttttcaactgttaaggcccggtgatccaatctccgacatagcggaatgtccgtccgtattctttcagtttagcccgcacttcccacgcctttccgaccaatacgatacttttatccttccggtacaccttcaatcgaaaagcacctccctctcatgcatgtatgataaaatatatgaggcataatagagagacagaacgggagatgacatgatgaaacatttagaagaaaaaacacttgcgaaaaaaaagctgtatgacgggaaagtcatagatctttacttagaggatgtagagctcccgaacggaaaaacaagcaagcgggaaatcgtcaaacatccgggagcggtggccgtacttgcggtgacagaagaaggaaaaatcattttggtgaaccagttcagaaagccgctggaacggacaatcgttgaaattccggccgggaagcttgaaaagggggaagagccggaacatacggcgttaagagagctcgaggaagaaacgggatatacggcggaaaccttgacgaaaatcaccgctttttatacatcacccgggtttgctgatgaaatcgtgcatctctttcttgcggaagggctttcgccgctggaagaaaagcgcgaactggatgaggatgaatttgtcgaagtcatgcaggtcacgcttgaagaggccgtgaagctgattgaatcccgcagggtgtatgacgcaaaaacggcgtacgcgattcagtatctccagctgaaagaagcgctgaaggaaaaatgatgaaaaccatctatgcggatctgcatattcatatcggccgcacctatacgggaaaaccggtcaaaatcaccggggccaaaacgttgacgctgcatcggattttagaagaggccagtgaggggaagggaattgaactattgggaatcatcgactgccattccccggaagtcatagaagaaatcgagcgcggaattgatgaaggcagataccgtgagctgaaagaaggcggcatccggtatcggaatacgacgcttctgttgggcagtgagcttgaaatctatgatcacacatgccgcgggccgattcacgttctcgtctttatgccgtctcttgccgaaatgaagatgttttctgagtggctcgcaaaaaggcttaaaaatatccatctcagttcccagcgtatttatgaaaccggtttgaatcttcaaaggaaaacaaaggaattgggcgggctgtttattcccgcccatatgttcaccccgcataaaagcctgtacggaaaaggggtcatatcttctttgacagaagttttcgacccggcgctcattgatgcggcagaactcggattaagctgcgacaccgacatggcttcgcgggtaacggaacttgatccgtatacatttttaacaaattctgatgcgcattccttaggaaaaatcggcagagaatataatgaaatgcttcttaaagaagcgaatttcacggaattttcgctggctttaaaagggaaggacggaagaaaaatcacggcgaattacgggctgaacccgaagctcgggaagtattaccggacggcttgcgaccgctgcggcagcccggttgaaaaaggagcttccgcctgtccggagtgcggggggaaaactatgacaaaaggggtcagtgaacggctggaggaactgagcggcccgaaaaaaagccgcgtgccgcggccgccgtatattcatcaaatcccgctgcagttcattccgggggtcgggccgaaaacgttagacaaactgaagcgggctttcgggacggagatggcgattcttcatcaggcgcaagaagaggaattggcgcatgtcgtccagcctaaaatagcggctgtcattcataaagcgcgcaccgggcagctcgtccttgaggccgggggcggagggacgtacggcagaatcaagccgtaaaagccggattttagcggagctcctcctgcaccttctttttcgtgcggacaaacgcaatcaattcgatgatttcatcctgattcagcggctgtccgtcaacggtcagtgtgccgcggccttgtgcggcgtttgttaattcgatggtctgggtaaacggctccgcctttttttcagtgcgccccagtaaatcgtcgcacgtcgtgtcaaacagatcggcaagcgtgcccagcgcctcgaatgacggacgccggtatcctgattcatacccggcgtacgtgcttttggcgatgccgagacggtcagccgtatattgaagagaccaatttttcttttttctcagttcagttaaacgatctaaattcatattcaaaaccgctccttttcacttgagcaaattatatcatatcgatatgcaaaagtgtacgcgaattgaataataatcacttgattaatttcaatcgtctgtctataatttgattaaaagtatgcgaaaagcgaatgcttaacacatcttgagaaatggatgaagaggtgcagggtatgaaaaaattattgctgttaacaaccggaggaacaatcgcctcagtcgaaggagaaaacgggcttgcacccggggtgaaagcagacgaattgttaacctacgtatcaaaacttgataacgattacacgatggaaacccattcgttaatgaacatcgacagcacaaatatgcagcctgaatactgggccgaaatcgcaaatgctgtcaaagaaaaatatgacgcatatgacgggttcgtcattacgcacgggacagacacaatggcgtatacatcagcggcactgtcttatatgcttcagcatgctgataaaccgatcgtcattacgggttcgcaaattccgattacatttcaaaaaaccgatgccaaaaaaaatatcacggacgcgatccgcttcgcatgtgaaggggtgggcggcgtatacgtcgtatttgacggcagagtcattcaaggcacacgcgccattaaattaagaacgaaaagctatgatgcatttgagagcattaactatccgtatatcgcgtttattaccgaaaacggaattgaatacaacaaacaagtgcacatgccaaaagacgatgcctttacggtcaatacctcactttgcacggacgtgtgcctgctcaagctccacccggggctgaaaccggaaatgtttgacgcattaaagggcatgtacaaagggatcgtcattgaaagctacggcagcggcggcgtgccgtttgaaggaagagacattctcgccaaagtcaatgaaatgattgaaagcggcattgtcgtcgtcattacgacacaatgtcttgaagaaggagaggacatgagcgtctatgaagtcggccgaagagtcaatcaagatctcattatccgctccagaaatatgaacacggaagccatcgtgccgaaattaatgtgggcgctcggccagtctcacaacttggctgaagtcaaaaacattatggagacaccgatcgcagacgacgttgtactgtaaaaacatgactaccacaaagagaaagtagggttttagcatgacaaacgcgcaaaaagaatatcgtcaggaaaaagatttcctcggagaaaaacaaattgaagctgatgtgtattacggaatccaaacgctgcgcgcgaaagaaaactttccgattaccggctaccgcatccacgaagagatgattaatgcgctcgccatcgtcaaaaaagcggcggcgcttgccaacatggatgtaaaacggctgtatgaaggaatcggaaatgcgattgtccaggccgcagacgagattcttgaggggaaatggcatgaccaattcatcgtcgatccgatccaagggggagccggaacgtccatgaacatgaatgccaacgaagtaatcggcaacagagcccttgaaatcatgggccataaaaaaggtgaatacattcacctcagcccgaacacacacgtcaacatgtcccaatcgacgaacgacgtgttcccgacggcaatccatatttccaccttaaaacttttggataagctccttgatacgatggcgcatatgctgagtgtctttaaggataaagcgaaacaatttgattctgtcattaaaatggggcgcacacaccttcaggacgctgtgccgatccgtctcggacaggaatttgaagcatacagccgcgtgctcgagcgtgacataaagcgaattaaacaatcccgccagcatctgtatgaagtcaacatgggggcaacggccgtagggacggggcttaatgccgatccgcgctacatagaacaggttgtaaagcacctggctgacatcagcggactgccgcttgtcggcgccggccatttggttgacgccacacaaaacactgatgcgtatacggaagtttcagccgcgttgaaagtatgcatgatgaacatgtctaaaatcgccaacgatctgcgcttaatggcttcaggtccgcgcgcgggacttgcggaaatttcactgcccgcccgtcagccgggatcatccattatgcctgggaaagtcaaccctgtaatggcagagctgatcaaccaaatcgccttccaggtcatcgggaatgacaatacgatctgcctcgcttcagaagcgggccagctggagcttaacgtaatggagccggtactcgtatttaacctgcttcaatccatcagcatcatgaataacgggttccgttcatttaccgatcattgtctggcgggaattgaagccaacgaaaaacgtctgaagcaatacgtggaaaaaagcgtcggcgtcattacagcggtcaatccgcacctcggctatgaagcggctgcgcgaattgcccgtgaagccatcatgacggggcaatctgtaagagatctctgccttcaaaatgatgtactgacagaagaagaattggatatcattttgaatccgtatgaaatgacaaaaccggggattgccggaaaagatctattagaaaaataaattttaaagcaacaacagccgccttttcacgtttttcagtgaataggcggttgccatacaaagggatgaggcagtatagtataatttgttatatcatttgatgaaagcgttttagcttttttcttctagggggattttcttgtgaaagaggtcagattgccaaatttattggaaattattatcttattattcgggtttttagcacttgtcttatcgttcacagtgtttttagacctgccgatccagctagctctattaatatcctggtttttcgctattattctcggagtcaggctgggatattcatataaagacttgcaggattcgattgtcaccgggatatcaaacggtcttgaagcggtgttgattctcgtttcggtcggtgcgctcatcgggacatggattgccggcggcgttgtgccgacgttaatttattatggtttagagtttattaatcctcatattttccttctggctacactggttatttgttccattatgtccgttgcgaccggaacatcgtggggaaccgtgggaaccgcgggaatcgccatgattgccatcggagagggaatgggtataccgcttccgatcgtagcgggagccgttttgtccggcgcttacttcggagacaagctttcaccgctgtctgacagtacggtgcttgcctccacgctttctaaggtggatgtgctgtcacacgtcagagcgatgatgtatctgtcaattccgtcctatattattacggccattctatttaccgtaacgggatttatatacggcggaaaaaatattgatctcgacaaagtggaatttttaaaatcttcattgcagaaaacgtttgatattcatatatggatgctcattccggctgttgtcgtcgttgtccttctgattttgaaaaagccgtctatgcccgttattatcatcggtgctttgcttggcgcaatctgggcttccgtctttcagggaatgaattttgccagtgccatcgcgactgcttataatggtttttctattaaaacggacgtcgaatttttaaacggcctgttaaaccgcggaggcattaccggtatgctggatacgttagtcgttatcctgttcggtctcggttttggaggtattcttgagaagctcggcgtattaaaagtgattgtctcaacttttgagaaaaagctgaccacaccgggaaatgtgacgctttcgacattgatcgtcgcccttttaggaaacattttcggctgtgcgatgtacgtgtcattgatcctgacgccgaaaatcatggagaacagttatgataaactgaaacttgacagaagagttttatcccggaacgcagaggtgggcggaacgcttacttcagggatggtgccgtggtctgataacggcatctatatggccggcattctcggcgtatccacattttcatatctgccgttcatgtggctcagttttgtatctatcggactggcaatattgtacggatacacggggaaattcatttggtacacgaaagaaaaatccttgcaatctcaaaaattgggttaggaggttcatttcatgattacaaagcatatgattcggacgttaatgattgaaacgccgactgttcccggaaatctcggaaaagtggcaaccgccatcggagtgatgggcggagatatcggggaagttgaaaccgttaaagtcggcccgaactacacaatgcgcaacatcacggtgcaggccgaaaatgaggagcagctgcaggaaatcattcaagccattgaagctctcggtgaaggcatccggcttcatacagtctcagatgaagtgctctctgctcatgaaggcggcaaaattcaaatgaaaagcaaaatgccgatccggacattggctgagcttggccgtgtttatacaccgggcgtcgccgatgtgtgccgactgattgaaaacgagcctgaaaaagcgtccatctatacgacaatcagcaattctgtcgccattgtcaccgacggcacggcgattctcggcctcggcaatatcggttctgtcgccggaatgcctgtaatggaagggaaagccgcgctttttgaccagctggcgggtatcagcggaattccgattttgcttgatacctctgatccggaagaaattattcgcacggtaaaacatatttctccggggttcagcggaatactgcttgaagatatcggttcgcctcactgctttgacattgaagaccgcctgaaagaagaactggatattccggttatgcacgatgatcagcacggcacggcggtcgtcacgctcgccgccgccatttccgcttgtaaaagcgccggtcttgatttaaaagaagcgaaggtcggacagatcggtctcggcgcggcaggcgtcgccatctgccggatgtttatggcatacggagtcaaagcggtctgcggaacggacaagtcagaagacgcaatgaaccgcctcgctcagtacggaggtcagccgcttggaagcatcaaagatttaatggacacgtgtgacattgtgatcagcaccaccggagttccgggtctcattaaaaaagaggatgtcagaaaaggacatgtcattctggccttatctaatccgaagccggagattgaaccggaagacgcattacaagccggagccgcttatgcagccgacggccgctcggtcaataatgttctcggcttcccggggattttccgcggcgcgctgaacgccaaaagcaagaaaatcgaccatgaaatgcttgtggcggccgcagaagccatcgcctcttgcacaaaacacggcgatctcgtgcctcagcctttggatgcggacgtgcatcaggctgtatcagcagccgtagaacgggccgcggcaggaaaataaacaactcttacagtaccggacatgtgccggtgctgtttttttagatgaataggaaacggaattcttaggcaggctaacagatagcaaaagacggaataaagaggtgtcaatgtggattattttccgctgatccatacaaatatttgggatgctgtgatcggcgtgccggtcgtcttatgcgttacacagctgatcaaagtgttctgccgggttccgggcatattcgttcccacgattgcccttgctgccggaaatgttgtgtctatcgttttcggtcaccatgaacacgtgtatgcggggattttcatgggatttttttacggatacgccgctatggggagctattcatctgccaaaacgtctctgcgcgcttaccggtcgaaacatgagccgtattcatgaacacatcgggatttttttgttatgataaagaaaaggcaaaaaggagcgattggcacatggcgaagagcaaaacgaaaaaaatgcgggagcatctcagaagaaacgggatgcgtgacgcagtcttgtcaagggggacggcgccgcctttcagcacccatgaaagagtgacgaaaactaaaaaagacaggcttgaaagaataaagcataaaaaaaggaagccctatgatcaccggagtgatgacgggggttctttttttatgcccgaatctcgcgcctttctatgatttctctgtcatgttttctcttttctttcatacaatctactaaatcaagtcaatagattagcgggaggaaagcggtatgagaaaacaatcgtacaaagaactgttttttcgccatgtaaaggatcatctgtcactttatatatttgtgtttgtcttgtttttgatgggggtcattttcggggcgatcatcgtcaacagcatgaccatcacgcagaaagaagatttgtattactatttaagcaagtttttcggacagctgtctgacggaaaacatgccggcgcttcagaaatgttttggcaggccgtctttcatgatgtaaaatatttggggctgatgtggattctcggtatttccgtaatcggtcttccggttattttcattatggtgtttttaaaaggaatcgtcgtcggcttcacggtcggttttttagtgaatcaaatgggaatgaacgggtttttcctgtcatttatttcggttctgccgcaaaacgtcgttctcattccggcatatcttatcatggggacatgctccatcgctttttcactgaaactgatccggcagctgtttgtcaaacgcagccttcatgacgcgccgatccaatggttcggacgctacgccttcgtactgattctcatcgttttcttctcggtcatcgcttcactgctcgaagcgtacgtgtctccgctgtttatggaaaagctgtcttcacgcatattttagaataattatcacaaaataatacttttatttatcagtttataataattatagttggaactctgcgcgtattttgttataatgagtcatggaatgcggcgtaggagggaaagacatggaaaaccgtattgatcgaattaaaaagcagctgcactcgtcaagctacaagcttacgccacagcgggaagcaacggtaagagtgctgcttgaaaacgaagaagaccatttaagcgcagaagatgtatacctcctcgtaaaagagaaatctcctgaaattggtctcgctacagtataccgtacattagaattattaacagaattaaaagtcgttgataaaattaacttcggggacggcgtatcccgctacgaccttcgcaaagaaggcgcggctcactttcatcaccatttggtgtgcatggagtgcggagccgtcgatgaaattgaagaagatctgcttgaagacgttgaagaagtgattgaacgtgattggaaatttaaaattaaagatcatagattgacttttcacggaatctgccaccgctgccgcggggatgaaacagagtaaaagcctatgaaccttttctgccaggaaagggttttttgctgtttttatgtataaaagcctttgaaattggcataaggtgtactaacagccgccaaaagaaagggtcgatcgaaagatgggcagattcctgaaaacagccgcggatacgatcaaagtgtttattctgttcacaggttttaccgcgctgttctattatgctatgatatgggtgaattcagagtatgaaaactatcatcggtacgataaaccggaaggctccgccgtcaaagtggccaaaacggaacatgaggagaaagacggctggttcggccgattgatctttttttaccaaaacggggagtagatcaagagtgaaggatcaaattaaggatttcatccattatgtgagggttgaaagagggctggcccaaaatacgatgatgtcctatgagcgtgatctgaaaagttattctctcttcttaactgaaacccttcagatcacttcatggaatgatgtgacccgtcttcatattattcaatatttaaagcatataaaggactccgggaaatccggcaagacgtctgccaggcatttggcgtcgatccggtcttttcatcaatttctgttaagggaaaaagccgcggataaagatccttcggtacatattgaaacacaaaaaacagagcggacacttccgaaagtattggcgcttcacgaagttgagcggttattggacacgcctaagcttgacagcccgttcggtctcagggataaagccatgcttgaactgctgtacgcaaccggcatccgggtcagcgagatgatcgagctgaaattatccgacgtccatttgacgatgggatttgtccgctgcttcggaaaagggcggaaagagcggattgtgccgattggtgaagccgcttcccatgcgatagaagcatacattgaaaaagccagagggaaattattaaagaaaaacgtaaccgaagcgctttttctgaatcatcacggcaggcagatcagccgtcagggattctggaaaaacctgaaaaaaatcgccctggaagcggggattaaaaaagagctgacaccgcacacgctccggcactcttttgcaacgcacctgctcgaaaacggcgcggatctgcgcgccgtgcaggagatgctcggacatgccgatatttccacgacacaaatttatacgcatgtgacgaaaacaaggctgaaggacgtgtacaaacagtatcatccgcgcgcttaggagccgctgccagaggggccgcggctttttttgccggattggcggaatacagagaaggttctaattatttgaatcggcattgtcaacaagaatgtaaacggtttatacttgagttgtctgacctctgtaagctacaatggacagatggaagaaaaggaggcttttatgatgtctgaatacaaatataaccgggtatttttaattgtaatggattctgtcggaatcggtgaagcgccggacgccgccgattttaatgatataggcgcaaatacgctcggacatatcgcagagcacatgaacggcttacatatgccccatatggcgcagctcggtctcggactgatcggagacattaagggcgtggaaaaaacggagcaccctcttgcgtactacggaaaaatgcaggaggcgtcaaacgggaaagatacgatgacggggcactgggagattatgggcctctacattgaaaaaccgtttaaagtgttcccggaaggattcccggatgaacttcttcaggaacttgagcggcgttcaggacggaaaatcatcggaaataagccggcttcaggcacggcgattctggacgagctcggaaaagaacatatggaaacgggtgcgctgatcgtttacacatcagcagattccgtgctgcagattgcggctcacgaagatgtcgttccgctggaagagctgtacagcatctgtgaaacggccagagaactgacgcttgatccgaagtacatggtcggccggattatcgcaagaccgttcgtcggagagccgggcagcttcaaacgcacgccgaaccgtcatgattatgcgctcaaaccgttcggccgcacggtaatgaacggaatgaaagacagcggattagacgtcatttccatcggcaaaatttctgatatttatgacggagaaggcattacatcttcccgccgcacggtatctaatatggatggcatggacaaagtgattgaaacgctcggtgaagagtttacgggcctgagctttgccaacctcgttgattttgacgcgctgtacggacaccgccgcgatccggaagggtacggaaaagcgcttgaggaattcgacgcgaggcttccagaagtgtttgaaaaaatgaaagaagacgatcttttgatcatcactgcggatcacggcaatgatcctgtccatcacggcacggatcacacgcgggagtatgtgccgcttcttgtttacagcaaaaagcacaaacatacagaacagctgccgcttgcggatacatttgccgatatcggcgcaaccattgccgataattttaaaacggaaaagccggaatacggaaaaagctttttatcaagattacagtagggggactttttttgaaacaaaagatcgaacgtgctgctgcatttattaaagaacacgtgaaagaaacaccaaagatcggtctgattttagggtcagggctcggcgtattggccgatgaaattgaaggagccgtcaagcttacatatgaaacgatccctgattttccggtctcaacggtagaaggccatgccggccagcttgtgatgggaacgcttgaaggcgtgcaggtcatcgcgatgcagggccgctttcattactatgaaggctactcaatggatcaggtcacatttccagtccgcgtgatgaaagcgctcggcgttgaatctctcgtcgtgacgaatgcagccggcggtatcaacactgaattccgcgccggcgatctgatgattattacagaccatatcaactttacaggcaccaacccgttaatcgggccgaacgaagctgaattcggagcgagattcccggacatgtcagaagcctatgacaaagagctgtcaagcttggctgaaaaaacggccgatgagctgggcattcctgttcaaaaaggtgtgtatacagctgttacggggccgtcttacgaaacacctgctgaggttcggtttttaagaacgatggggtctgacgctgtcggcatgtcgaccgtgccggaagtcatcgtcgccaaccacgcggggatgcgcgtgctcggcatctcatgcatttccaacgcggcggcgggtattcttgaccagccgttatctcatgaagaagtaatggaaatgacggaaaaagtaaaaggcggctttttgaagcttgtcaaagccgtagtcgcacgatctcaaaaataagtcagcataagtcagctgtttcttcggaagcagctgtttttttgtgccctcaacacgaaacattttccagatgaggcgtataaaaccaccggatttggaaaaaataaaaaggattatgaaatggagggctttggagatgaaacgtcttatatccactttgttgattggcattttattaacggcatcagcaccgtccgcttttgcaaagccggacggaaaacatacatcggagctcgctcatgaagccaaaagcgccgtgctgattgaacgcgatacgggaagcattctttataacaagaacagccgggagcgtctggcgccggcaagcatgacaaaaatcatgaccatgcttttaatcatggaagcgcttgacaaagggaaaataaagatgagcgataaagtcaggacgagtgaacacgccgcgtccatgggcggatcacagattttccttgaacccggagaagaaatgacggtaaaagaaatgctcaaaggaattgcgatagcttccggaaatgacgcatctgtcgcaatggcggagtatatcgccggttcagaagaggatttcgtcagccggatgaacaaaaaagcaaaagaattgggattgaaagatacctccttcaaaaacccgacaggactgcctgaaaaagaccattacagctctgcttatgacatggcgaaaatggcgaaggaattattaaagtacgataaaatcactcaatttacgggaacgtatgaggattatttaagagaaaatacagacaaaaagttctggctcgtcaatacaaaccggctgatcaaattttacccgggtgtagacggcgtgaagacgggctttacaggcgaagcgaagtattgtttaaccgccaccgctaaaaaagggaatatgagggtcattgctgtcgttttcggagccagcaccccgaaagaaagaaacgcccaagtgaccaaaatgcttgattacgccttcagccagttcaaaacacacccgctgtacaaacggaatcaaatcgtcggaacggtaaaagtgaaaaaaggaaaacagaaactgatcaagctgaccacatctgagccgatttctcttctggccaaaaagggagagaacatgaacaaagtaaaaaaagaagtgaaaatcaacggcaatgtaacggctccggttaaaaaaggagaggtgctcggcagcctcgttctgaaaaaagacggaaaggtgctcgttgaaagcccggtcacggcaaaagacgacatggaaaaagcgggttttctcacttttctgaagcggacgatgggagattggacaaaatttaaataatcatggcgaacgggcactagttttgtcatagtgaaggaattgctttcccgaaaatcgaaacactcattatccgatcatacaaggaggaatgagcatgagccttggaattgactttcatgtcaaagaatccgtgctttgtattcgattaacaggtgaactcgaccatcatacggcagaatcattaaaacaaaaggttactgaatcgctggaggctgacagcatccgtcacattgtgctgaaccttgaagatcttaccttcatggacagctccggcctcggcgtgattttagggcgttataaacaaattaaacagctcggcggagaaatggtcgtgtgcgcgatttcgccagcggtgagacgtctgtttgacatgtccggcctgtttaaaatcatcaggttcgaacaatcggaacaaaaagcgcttttaacgttgggggtggcttcatgaaaaacgagatgcatcttgaattttcagccctcagtcagaacgaatcgtttgcgcgcgtaacggttgcttcttttatcgcgcagcttgacccgacgatggatgagctgacggaaatcaagaccgtcgtatcagaagcggtaacaaacgcaatcatccacggctatgaagaaaactgcgacggaaaggtgtacatctccgttacgctggaggatcatgtcgtctatctgaccatacgtgacgaaggcctcgggatcacggatcttgaggaagcgcgccagccgctctttacgacaaaacccgagcttgagcgctccggaatgggctttaccattatggaaaactttatggatgatgtcacgattgattcctcgccggagatgggaacgacgatacgcttaacaaaacacctatcaaaaagcaaagcgctttgtaattaaggagatttgttatggatgtggaggttaagaaaaacagcaaaaacgcgcagctcaaggaccatgaagtcaaagaattaatcaaaaagagccaagagggcgaccagcaggcaagagacctcctcatagaaaaaaacatgcgtcttgtgtggtccgtcgttcaaaggtttttaaacagaggctatgagccggacgatctgtttcagatcggctgtatcggattattaaaatccgttgataaattcgatttgtcctatgatgtccgtttttcaacttatgccgtgccgatgattatcggagaaatccagcgcttcatccgtgatgacggaaccgtcaaagtatcaagatctttaaaagagctcggcaataaaatacgccgggcgaaagatgaactgtcaaaaacatacggaagagtgccgaccgtccaggaaatcgcggatcatttagaaattgatgcggaggatgtggtgcttgcgcaggaagcggtgcgggcgccttcatccattcatgagaccgtgtatgaaaatgacggagacccgatcaccctgcttgatcagatcgccgatcattcagaagagaagtggtttgacaaaatcgccctcaaggaagcgatcagtgatttggaagaacgggaaaaactcattgtctatctgagatattataaagatcagacacagtcggaagtagccgaacggctcgggatttcccaagtccaggtatcgaggctggagaaaaaaatattaaagcagattaaagtgcagatggatcatacggaaagctgaccttttacgggccggctttttttatttgtgcatcggtggtaatttatggtcttttgccgctgatgaatgagaacaaaagtgaaccacatactacatatataaccacccgaaagatggtgatgcaagatggaaagacgaatatttctcagacttcgccaccgcgtgaaggctcataccggagatatcatcacagtcggcgacgccgcgcagattgcgggacagcaaaagctgaaaaaaaaactgtcggcactgccgctgtataaggtcacgaaaaaagacaaaaatatcgtcgtgctggacatcataaaagtgctgaaaaccattcataccgcttttcccgcgcttgatgtacagaccgtcggcggcgctgaaacgatagtggaaatccattaccagaaaaagcagctgtcagccgttttattcgtcggtgtctggctcctgctttttatcggttcatgtcttgccattatgaattttcatgaagatgtcagtatgagagaagttcatatcgccttatatgaaatcataacgggcgaacggaatgaatacccgtatctgcttcagattccatacagcatcggcctcggtctcggtatgatcgtcttttttaatcacatcttcaaaaaacgcctgaatgaagagccaagcccgctggaagtcgagatgtttaattatcagcttgatctcgatcattatgtcgcaatgcacgaaaatgaagagacgatgaaagatctgcatgatcgttagcattcttttcgttgtatttgtcgggcttggcggagggctgaccgtgggcgcgggctttgtggcttttttaaccgttatgggaatcgtcccccgccttatgcagctgacaaaaacaatgcgctttgtacaggcctacgaaggagctgttatttcaggagctgtgttcggcggctgggaaaccttaaatatgaatcatttttttttatctgaatggctggccgttccggtcgggcttttggccggcatgtttatcggcatgctggccgccgcgcttacagaagtgctgaatgtgcttcccattcttgccaaacggatcggcttcggcagcaaaatcattatattgctgatggccattgtgttcggcaaaatagccggctctttatttcattggctgtattttatccatcattcataaggaggaaccgacgtgacaaacttaaaagaaaattacaaaacaaaagtgaaagactatcagccgaaaccgccatatgtttggaattgcgtcaaagcctttctgatcggcggtttgatctgtctgatcggacaggctcttcaagacttttacatccacttttttaattttaatgaaaaaacagcgggcaacccgacggccgccactcttattttaatttccgcccttttgaccggattcggcatttatgacagactcgggcagtttgccggagcgggttcagccgtgccggtgacgggttttgcaaacagtatgacaagcgcggctctggaacacagaagtgaaggactcgtgctcggagtagcgacaaacatgtttaaattggcgggaaacgtcattgtattcggcgtcgtggcagcctatatcgtaggcctgatacggtttgcttgtgaaaaactgttttcgtaggaggagaaaaaatgaaattaaccggaaagcaaacctgggtgtttgaaaacccgttatttgtaaatgcggcggggacggcagccggaccgaaagaaaaagacggcccgctcggttcgctgtttgataagacatacgatgaaatgcattgcaatcagaaaaactgggaaatggcggaacgtcagttaatggaagatgccatcaactcagctttgcaaaaacagaatttgaaaaagagcgatattgatttgttactcgcgggggatcttttaaatcaaaatgtgaccgccaactacgtcgccagacatctgaaaattccgttcctctgtctgttcggcgcctgttcgacatcaatggaaacgattgccgtcgcatccgcgctcattgacggcggttttgcgaaccgggcgatcgcagccacgagcagccataacgcgacggcagaacggcaattccgcaatccgacggagtatggcgggcaaaaaccggataccgccacttcaacggtcacggggggcggggcggtcatcatcagccaaaacccttctgatatcaagattacaagcgcaacagtgggaaaagtaagcgacctcgggattacggacccgttcgatatgggatccgccatggcgcccgctgccgccgacacaatcaaacagcacctgcaggacttaaaccgcacggcggatgattatgatctgattttaacgggagacctttcaggcgtcggctcgccgatcgtgaaagatttgctcaaagaagaaggctatcccgccggaacgaaacacgatgactgcggtcttctcatctatacgccggaccagcaggtgtttgcgggcggaagcggctgcgcctgctccgcgcttgttacgtacacacatatttttaatcaattaaaatcaggggctctgaacagggtgctcgttgtcgcgacaggagcgcttttaagtccgacaatgatccagcagaaagaaaccattccgaccatcgcgcacggtgtggtatttgagcgggcgggaggtgcatcataaatggaatatctgttggcttttgtttgcgggggaatcatatgcattatcggtcagctgctgcttgacatttttaaactgacacccgcccatgtgatgacaacttttgtcgtcatcggcgccttgttggatgggttcggaatatatgacaaatttatcgaatttgcaggtgcgggcgcgacggttcccattgtcagcttcggtcacagcttattgcacggcgccatgcatcaagctcacgagcatggatttatcgggatcgccatggggatttttgaacttacttccgccggtatatcttcagcgattttattcgcatttcttgtagccattatttttaaaccgaaaggataatgcctgatgacgaaacggaaggtcattcttgtgacagacggggacgtatacgccgccaaaacaattgaatatgccgcggaaaaagcaggcgggcggtgtatttcccaatcaaagggcaatccgtcaaccagaagcggccccgaacttgttcagctgattaaagccgcgccgaatgacccggtgtttgtcatgtttgacgattcaggcctgcaaggggaagggccgggcgaaacggcgctgaaatatgtcgcctcacatcaggacattgaagtgctgggggtgattgcggtcgcttctaagacccatcaggctgaatggacgaaagtcgatgtctccattgaccgtgatggagaagtgacggagtatggcgtcgataaaaccggaatgagagaaatggacgagcacagaatgaacggagatacggtgtattgtctggataaattggacgttcctctcattgtgggcatcggcgacataggaaagatggggagaaaagatgacatatccaaaggctcgccgattacgatgaaggcggtcgaattcattttagaaaggagcgaaagtcatgccggaaaaaccggaaaacatgatcaaggtataccgggatcctagaaaaaatgaacaattttttaaagaccgcgtcggtatgggaacgagctatgatgtcggcgtccgcaaagttcgagtattagaccgggaagtccagatttactttgtcaacggattaaccgatactttgtttatcattcatttaatggaacagctcgtcgacgtcaataattatgatgagaatgcggatgaagcgattgacgttgttgaaaacaggcttgtcaatcagcaggtccaaaaagtcaaaacgctcgacgaagcaacagaccaagtgctttccggacttgtggccgttatcgttgaagacgcgggcttcgcctttatcgttgacgtcagaagttaccccggacgcacaccggaagaaccggatacggaaaaggtcgtccgcggggcaagagacggttttatcgaaaatatcgtcattaatacagcattgatcagaagacgaatcagggacgaaaggctccgcgtcaaaattacgaaagtcggcgagcgctctaagaccgatcttgccattgtgtatatagaagacatcgcggacccggaccttgtcagcatcgtcgaaaacgaagtgaatgcgattgacattgacggattgacgatgtctgataaaacagtggaagaattcatcgtcaaacagggctacaacccgtttccgatggtcagatacacggagcggccggatgtggccgccaatcacattttggaagggcacgtcatcatcgtcgttgatacgtcaccgagcgtgatcataacgccgacaacgatttttcaccatgttcagcatgcggaagaatacaggcaggcgccttcagtgggaacatttttaagatggatcaggttcttcggtattatcgcttcaacggttctgcttccgatctggtttctctttgttctcgaaccgtctcttctgcctgaaagattggattttatcggtttaaataaaaatacgcacatcccgatcattctgcaaatctttttagccgatttggggattgagtttctcaggatggccgcgatccatacgccgaccgctttatccaccgccatgggtctgattgcggcggtgctgatcggtcaaatcgccatagcggtggggctgttttcagcagaagtgattctgtacgtatcgatcgccgccatcggatcatttaccacgccgagctatgagctcagcctcgccaataaaatgatacgcctcatcttaatggtgctcgtggccattttccaagtgaaaggctttgtgataggctttacattgctgctgatcataatggcgaatatccgttcgtttcatacgccgtatttatggccgtttttaccgtttaacggcaaggcgctgtggcaggtgctcgtccggacgacagtgccgggagcgaaagtcagaccgagcattgttcacccgaaagaccgtcaaagacagccaagcggttcataatcgcattgaaaccgacagaagattatgatattgtatgtcttaacttatacgggacttgtataaggacagctcaaaagaagctgtccttttcacccataggcggatcagaaagagggaatgagcattgttcttacatggcacaagcagacaaaacaaactaggtcatttggaaatcggaggtgtggacgcgctgtatttagcggagcattacggcacgcctctttatgtttacgatgtggctttaatacgtgagcgcgctaaaagctttaaacaggcattcattgacgcggatttaaaggcgcaggtcgcgtacgcgagcaaggcgttttcttccgttgcgatgatacagctcgctgagcaggaggggctctcattggacgttgtatccggcggagagctgtttacggcggttgcggctggttttccggctgacaggattcattttcacggcaacaacaaaagcaaagaagagttgaaaatggcgctcgatcatcaaatcggctgcatcgtcgttgataatttttatgaaatatccttactcgcggaactgtgccgcaaatcagggcgcacaatggatgtgcttctccggatcactccgggggtagaggcccatacgcatgattatattacaacggggcaggaagattccaaattcggttttgatctgcataacgggcaaatagaaaaggcgattgaacaagtattgcagtcagaccatatccgccttctcggcgttcactgccacatcggatcgcaaatttttgatacggcgggctttgtgctggccgcagaaaaaatctttgcaaaactgaatgaatggagagaatcattcggctttgtctctgaagtgctgaatttagggggcggcttcggcatccgctacacggaagaggatgaaccccttcatcccgccgtttatgtggaaaaaattatcgaagcggtaaaagaaaacgcagcgctgcacgcttttgacattccggagatctggattgaaccgggacgctcgctcgtcggagatgccggaacgacgctttataccatcggttcgcaaaaagaagtgcccggcacccgtaaatatgcagcggttgacgggggcatgagcgataatatccgtcctgcgttgtatcaggcgaaatatgaagccgtatcggcaaacagaatcggagaacaccacgacaaaacggtatccatcgcgggtaagtgctgtgaaagcggggatatgctcatttgggatatagaccttccggaagtgaaagaaggcgatcttctcgccgttttctgcacgggagcgtacggatacagcatggctaacaactacaaccgtattccgcgtcccgccgtcgtttttgtggaagacggcgaagcacatcttgtcattagaagagaaacttatgaagacattgtaaaactggatctgccgtttaagacgggggtcaaacaataaataaaaaagagaccggaacaatggcgtccggtctctttttgcgttcagctgtcagaacttgatccgctgtctcctgtaaatacagacacgattgcattccaaatcgaagcgaagaaatcaataactttttgaacaaagcttttgccttcatcggattgaatgaacttcgtgattttgtcttttgccttatcgagctggctgccgacttggccccaatcaatctttgcatttttcattttattaaacaatgaaacgagctggtctttttgagcgtcagtcagtgtaatgttaaggtttgaagccgcatcatcgacctttttctcgattccttcttttgtatcgggcacaccgtttttcgcgaaatcatctttaatgtttgcgataagcgcggaggcgtttttatccccgattttatccccgagatttgaagtggtgacaagctcttggttggcgacctgttttacatcttctgaaatcgctttgtctgatgagacttcatatgccttgatgattcccgttaatgctgcggtgcctgatacctcaaacggcgccgtcacgtatactttcgcatctttcactcctgctgtcatcagggcgtttaagtacatttcatccgtaatggaatcgatattatgggtcttaacgtcaagcccggaccctttctttgccaccgtaatggatgacgaagagatggctcttgtgccgatttgggcattcgatatatattttcccagatattcatgttcttctttattagtgaccgtcacttttgtcgcgttatcagggacatttaattcgtcaagcactttctgacggttttcgtttgacagatccgcccccagtgtgacgatgacatctccgactgcggcatcggccaggctgattttcggtattgtgcacaatacaacggccgccgccagcaatccaatccacatttttttcaaagcggttaacctccttcttttcacaaatgccgttttgaagcggtttgtgaggacctgcgtgaagcagttccgatacatagacggctgtgaagctgttctggtttcattttctttctgcggaagcggggagattcgttttccggctgaaggtgtggtataatagccgcgaaaagaagagcagaagcctcttccttcaaaagaatatcaaaaagaaagccggcttacaattgaaattcatattaaagaaggctttgacaaaaaaaatacggaagtaggaatgagaatgaaaactggttacatcgaaatggaaaacggcagcagaatcgaatttgaactttatccgaatgaagcgcctaatacagtcgctaactttgaaaatctggcgaatacgggcttttatgacggcgttattttccaccgcgtgattccgggctttgtcagccaaggcggagatccgactgggacaggcatgggcggaagcggaaaaacgatcaaatgtgaaacagaaggcaatccgcataaacacgaagccggttctttatcaatggcgcatgccggtaaagacacgggttcaagccaattcttcatcgtacatgagccgcagccgcatttaaacggcgttcatactgtattcggaaaagtgacaagcggtttagagcatgcgaaaaacatgtctaacggagacaaaatgaaagaaatccgtgtagaaggataatgacggaaaacccgcctttttcaggcgggttttttttatgtatatgaaaattctcatgtgtaaatcatgaaaaaatacatatatgaacatcggtgatcattctggtatagtgaaaaagaccgattacaacaatgaaaagaggtagaaacgttggttcaattggcaaccgttttatttgtcattatcattctcgcacttatgatttggttcagggtaaaaaagggaaacaggccgattaaaggcggcggcttaggcatcattctcccgcttttgattatcgccgtcattttcacattcagtatcagccagctcatgaatatcccgggaaagccgtttcattttcccgctctttgggagctcgccatcgccggactgttaggcgcggtattcggtatcatcatgctgtcgcaaaccgcctatgaaatccgggaagacggctttgtctactccaagcggaataaaaactttaaatatgtcattatcgcgattattgcgatccgtatcgcgctcagccaatatttcaaaagcattgacgcggcggaattcgccgttttaacgatggagcttgcttttgtgtatttgtgcatttggcggatcggaagcttcgtgaaataccgtaaaatcagcagatccggcttataaaatgaaaaaaatggatggggtgcggggcttatttgccctctgtgcagggattcatggtaaaataaaaatgaccatggctaatgggaggaaatcacttgaaatcagaaaaagaaaaaacttctaaaaaaagcgccgtacttgattgggcgaaagccattatcatcgctgtcgttctggcactgctcatccgaaactttttatttgccccttatctcgttgatggaagatcaatggatccgacgctgcatgaccgcgagagaatctttgtcaatatgacggtcaaatacataagcgacttcaaacgcggccagatcgtcgtgctgaacggagaaaatgagcactatgtcaaacggattatcggacttcccggcgacacggtgcaaatgaaaaacgatcagctgtatatcaacggcaaaaaagtgtccgaaccgtatttagcggcaaacaagaacaaggcgaagcaaggcggctttgaccggctgacggaagacttcggcccggtgaaagtgccggacgacaaatatttcgtcatgggtgataaccgcagagaatctatggacagccgcaacggcctcggtctttttacgaaaaaacaaatagcgggcacatcaaaattcgtcttcttcccgtttaacgaaattcgcaagacgaaataaaccgtacaggcagttttcttcatgagaaaactgctttttttatataaatttatcactccaccctcaaaaacagaacataaattcgtatatctatttaatagatagaaagttttacagatacatgaaacatcttccctttatgaaacgttatatgaataactcacgcagggaagaacggttttctattcatgaaaaaaaggaatatgacatagtaatgaatagattgatacgggctggaggtagaaaaatgggaagaattaaaacaaaagcagccattttacttgtactgctgctgttattagcgggcggttatatggtcataaacgatattgaactgaaagacgtgccgactgcaatcggacaaaccctgtcccaggaaaaagaagaatatacagtcaaaacatataaaattacgaaaatcgaaggaactgagtaccacggtacggcagcgaacggcacaaaaattatttttaacggcgacaagctgaagcaggatctctccgatgtaaaaaaaggtgataagattaaagcgtatttcagcaaatcaaaccggattgacggcttattgaaggtcgtcaaagtgaacgaataaataaagacgccttttatgggaaaagggcgctttttatttttctgaataatgaggtgcaaattcattgcgcctgccgcaaaggatgttataatagcggataaggacaaaaaaatattgattgtatccttcggggctgggtgaaaatcccgaccggcggtaataaggcgctttgcgctttacagcccgtgacccgtatgcatctgtatacggtggattcagtgaaaagctgaagccgacagtgaaagtctggatgggagaaggatgagagaagctatgcaaaaaataaacttactgtatagtcttatttcctatggattaaaactggcaaagccccgaactgtgtaaacattcggggcttttttgacgccaaattgcgtggaagaagggagggataacgatggatgaatattatatgaatacggcaatagaacttgccagacgcggtgaaggacagacacagtccaatcctcttgtcggcgctgtcgtcgtcaaaaacggacagatcgtcggaatgggcgcccatttgcaatacggagaagcgcatgccgaggttcacgcgattaatatggccggcagacacgcaaaaggcgccgatttgtatgtgacgctggagccttgcagccattacggaaaaacaccgccatgcgccgaactgataataaagtcggggataaaaagggtgttcattgctgtgaaagatccgaatccgcttgtagccggaaaaggcatcggaatgctggaagcagcgggcatcgaagtgaaaaccggccttctcaggcagcaggcagaagagctgaataaaatgtttcttcacttcatgcggaccggacttccgtatgtcaccttgaaagcggccgcgagccttgacgggaaaacagcgaccgaaaccggtgacagcaagtggattacatcagaggcggcaaggcttgatgcccagcaatacaggaaatcgcatcaaagcattcttgtcggagcaggcacagtcaaagccgataatccgagcctgacctgcaggcttcctgatgcggtgaagcagccggtcagagtgattctcgatacaaagctgaccattcctgaaacggcaaatgtgctcactgacggcgctgcgccgacatggatatttacggccaaaggtgcagacgtgcaaaagcaagaccggctgaccgcactcggaataaaagtttttccgctggaaacagaccgcattcacatccctgaggtgctcagtattctcgctgaaaacggaataatgtccgtttatgtggaaggcggagcatccgtacacggaagttttgtcaaggaaggctgtttccaagagcttcatttctatttcgcccctaaattaatcggaggaacgcttgctcccagcttgatctccggtgaaggttttcaatcaatgaaagatgtcccccatttgcaattcacacaaatcacccaaatcgggccggatataaaactgacggccatacctaaagatggaaaggatggtgacgatgtttacaggaatcgttgaagaaacaggcacgatccaagcaatcaaaaagacaggcctttccatggcattaaccatcgccgcttcaaaagtgactagcgatgtgaaacttggcgacagcattgcggtaaacggcatctgcctgaccgtaaccggattttctgacaatcaatttacggttgatgtcatgccggaaacagtgaaatccacttcgctgaacggcttgtcaaaaggcagtaaagtaaacctggaaagagcgatgtccgccaacggacggttcggcggccactttgtatcagggcatgtggacggaacggcggaaattacgcggattgagaaaaaaagcaacgcggtctattacgatttaaaactttcgccggaattgacaaaaacgctcgtattgaaaggttcaattacggtagacggcgtgagcctgacgattttcggtctatcagatgaaagcgtgacggtatccatcattccgcataccatctcagaaacgatttttcagacgaaaacagtcggatcgaccgtaaatattgagtgtgacatgatcggcaaatacttataccgctttttgcacaaaacagaacaaacgaaaagcaatcaaactatcacggaagcctttttaagcgagaacggcttttagaaaggaagatcgatatgtttcatccgatagaagaggcgttagaggcgctgaaaaaaggtgaagtcatcattgttgtcgatgatgaagacagagaaaacgaaggagatttcgtagcgctggctgagcatgccacgcctgaagtggtgaattttatggcgacccatgggagaggcctgatctgcacgccgctgtctgaagacatcgccggccggctggatcttcacccgatggtcgatcataatacggactcacatgagaccgcctttacggtcagtattgaccacaggctgacaaaaacgggcatcagcgctcaagaacgttcttttaccattcaggcgctgttgaacgaggaatctgggtctgacgattttcagcgtccgggccacattttccccttaatcgcaaaaaaaggaggcgtcctgaagcgggcgggccatacggaagcagccgttgaccttgcaaaagcctgcggatctcagggagcgggcgtcatttgtgaaattatgaatgaagacggcacaatggccagagtgccggagttagccgaaatcgccgaacgccaccagctgaaaatgattacgataaaagacttaatagagtaccgttacaacattacgacacttgtgaacagagaagttgatattacgctgccgactgacttcggcacgtttagagtttacggatatacaaacgaggttgacggaaaagaacatctcgcctttgtcatgggggatgtcccgtttaacagcgaacccgttcttgtcagagtgcactcagaatgcctgacgggcgatgtgtttgcatcccatcgctgtgattgcggacctcagcttcatgccgcgcttgcgcaaattgctgaagaaggccgcggcgttctattgtatttgcgccaggaaggcagaggaatcggtttaatcaataagctgaaggcgtaccgattgcaggaacaagggtacgacacggttgaagcgaacgaagcgctcggctttctgcctgatctgcgcaactacggcatcggcgcccagattctccgcgacttaggggttcagcatatgaaacttttaaccaataacccccggaaaatcgccggcctcgaaggatacggtctcagcatttcggaacgggtgccgcttcaaatggaagcgagtgagcataacaagcagtatttacagaccaaaatgaaaaaacttggacatctgcttcatttctaaaaacaaatctcacaaaaaaggatggataacatatgaatatcatacaaggaaacctagtaggaacaggacttaaaatcggaatcgtcgtcggcagatttaatgaatttataacgagcaagctgttaagcggagcggaagacacgctgcttcgccacggtgtagaatcaaacgacattgacgtcgcttgggtgccgggagcgtttgaaatcccgtttgcggcaaagaaaatggcggaaacgaaaaaatacgatgccgtcattacgctcggcacggttatcagaggagcgacaacgcattatgactatgtctgcaatgaagcggcaaaaggcatcgcccaggcgggaacggcgacgggcgtcccggttatcttcggcatcgtgacgactgaaaccattgagcaggccatcgaacgagccggaacaaaagccggaaataagggagcggattgcgcagtatctgccattgaaatggcaaatttaaaccgttcatttgaataatttgttgaaaagcgtttaaaaccgcggcgaaaatgatataatgtgagaaaacggatcgcctttatgtatccgtttgataggacatgaatggacattttggatatagaggggtttttatgttaattcgttataaaaaatcgtttgaaaagattgcgatgggtcttctgtcatttatgccgaatgaaaaagatctcaagcagcttcagcagacaataaaggactatgaaacggatactggccgccagctctttctttggaaagaggatgaagatatcgtcggagcgatcggagtcgaaaaaaaggactcagaggttgaaatccgtcatatcagcgtgaatccttctcaccgccatcaaggaatcggaaagcaaatgatggacgccttaaaacgtctgttcaaaacggaggcactcgttccgaatgaattaacgcaaagcttttttgaacgctgtcaacatcaaaaagatcaggatatctcatataataactgacaaatgctcccggaatcttcacggtttcgggagctgttttgatatagaaaaagcagggctgaccgtcagcctctgcttttttttcttctctcaatttcccgttcgcgttccttaatgacatccgtcctgtcccgcaggcggtgtttatgaataagaaaggtatctgatacgccgtcttgcccccatgtatagccctttcggcggcattcggcaagacatgcttctttcagggcttcatctgtaatcggaagcataacacttctgtaaggcaggcccgcttctatatcgtctgacagcgtttctatcagctcaatcagcttcggatggctgagaccgagagaacagaccgcctgcttttcagaccggagaatacgtaagctgttggcaatcagccgtttcgccccggcttcatttcccctgcgctggtgatacagagcgacggcaagctgaatcaggccgacccaatgaatgctccgcttttcagccgggctttctttccaatattcctctaacagttcatgacactcaaaataatctcttgatgcgtgaaattcggccaaaaagccgatataagctttaggatacaagccgcttcctccttttatgctaaaaccagtgtaccacagcgctttgaaaaggaaaaaagagcggcttggtgtctgaagcctgaggaactagcagatgtaagatgctcctacgacaacgagcaaaataaacagaacgacaattaatgcaaaacctccgccgaaacaagctccgctcatgtgaaatcagcctccctttgtttcaagtttacacggctatcctatgtgcatccgcctttaaaggtataggcgtatatcttctttttcagtattttctaaataacggaggacgtgtataaaagtattggacgagagcatttcggtggattatactaaagggtagccagtttttccggcaatgagagtgatactgaaaatggtgagataatggtagaatatcaagtgaaaattgatacgtttgaaggcccattggacctgctgcttcatctgattaaccgtcttgaaatcgacatatatgacatacccgtggcaaccattactgaacaatatttattatatgtacatacaatgcaagagcttgaacttgatgtcgccagtgaatatctggtcatggcggcgacgcttctcagcattaaaagcagaatgctgcttccgaaacaagaagaagagctgtttgaagacgaaatgcttgaagaagaagaccctcgggacgagctgattgaaaagctgattgagtatagaaagtataaaaccgctgcgaaggatttaaaagagcgagaagaagaaagacaaaagtcatttacaaagccgccgagtgatttaagtgagtatgcaaaagaaatcaaacagaccgagcagaaactgtcggtgaccgtttatgacatgatcggcgcgtttcaaaaggtgcttcagcgtaaaaaaatcacgcggccgaaagaaacgaccattacaagacaggaaataccgattgaagacagaatgaaagaaatcgtaaaaagcttaaaaacggcggggagaagaataaacttcacggagctttttccttctcggcaaagggaccatctcgtcgtgacgtttttagcagtcctggaactgatgaaaaatcagcagattatcattgaacaggaagaaaacttttcagatatatacattacggggagtgaatccattcatggcgtttgatatcgtgaattggaaagcgattgtggaagccctgctgtatgcggcgggtgatgaaggactgaccaaaaagcaattggtgacggtgcttgaaatagaagaagcggaactggccggaatcatggaagaagtggccgctcagtacaaggaagacgacagaggcatcgagcttaccgaatatgcggatacgtatatgcttggaacgaaaaaagaattcgtgccttatttgaaaaaactaatcgaagtgccgtcaaaagggctgtcacaggcttctttggaagtgctggcgatcgtttcgtacaagcagccgatcacacgggcggaaattgaagatatccggggcgtgaagtctgagcggattctgcacagcctcgtgtcaaaagcgctgctgtgtgaggtgggccgcgccgacggtcccggccgggcgattttatacggcacgacaccggtatttcttgaacaattcggcttaaaaacattggaggagctcccgccgcttcctgaaaatgcggaggaagacgttctccaggaggaagccgatttattctttgaaaacttcaaccaaacttttgaggatattaaataataatcgtttttcatcatacgatagtagggaaaggccattgatgaatgacgcaaatgacgacgtacaagagaggaaggaaacggacggaaatgggaaattcgattgtgagggcccatactgaagaaactggtgaatttttagccgaggttgtcacgatggtcagcagctatttaaatcatacaacattgccggagatgcgggctcaaggagaggcggatgaggcatactgccgcgacgtgctcagtgtgctgaggaggatgaccgtcttttgcgaaggcgcccaggaagcctgccggcggctcttaatgcaggagccgtttcatgaggtgagagcggaaaaaacgctgtataaagtgtatcatcagtgcgtggaagaatttttcatgccgaaaaaggatacatggtacgaaaacagccgcgccgcttatacaggccaaagcgcgattgaattctaccagcaagtgccggactcgctgcggagccttctgctttcgctcagcagtgaatttctgcggatgcgggaagaattggcgcaatatgaagcatcaggctcaaatatggcatcagtcagataaaaactcttccttttgggagagtttttttatgtgaaagtgatgcaattggtattcataagtcatggacaggcgcataaacttgtacaaacccacaacaaggacgtgagcattcatgcgctttctcaaaaaagctgccgtatttcttttgacttttgttattcttttttccattacagacggcaatacggcacatgcccaaatacatgtcagcgcaaaaagcgcgattattatcgacggagcatctggcagggtgttattcgccaaggatgaacatcataagcggcggattgcaagcattacgaaaatcatgacggcggtgctggcgattgaatcagggaagatggaagagaccgtgacggtttccccgaatgccgtaaaaacggaaggctcagccatttatcttcagccgggacaaaaagtaaagctgaaagatcttgtatacgggcttatgctgagatcaggaaatgacgccgctgcggcaatagctgaatatgtcggcggaagccttgacggttttgtatttatgatgaacaaaaaagccgagcaaatcgggatggaaaatacaaaatttcaaaatccgcacggactggacgaccatgaaaatttatattcaacggcgtatgacatggcgcttttgactaaatacgcaatgaaaatcaaggaataccggaccgtttcaggcacaaaagtgtataaggcggaaacgatggaccgggtatggaaaaataaaaacaagcttctgactgggctctaccgttacagcacaggcggaaaaacgggttacacaaaaatcgcgaaacggacgctcgtttcgacggcttcaaaagacggaacggatctcatcgcggtcaccataaatgatccggatgactgggatgaccatatgaatatgtttaattacgtctttgagcactataaaacctatgtcgtcgctaaaaaaggcggcatcccgaagctgaaaaagacgttttacggaaaacacgcttttattgcccgggatgtcaaatatttattaaaagaggatgaaatcgacgatgtaaaaatccgcacaaccttaataaaaccgaaaaaagcctggaaaaaggacgcctctctcattcctgatgtcgtcggccggatgactgttatgcatgatgggaaagtgatcgccaagattcccgtctattatgaaaacgagcgccataaaaaaccgaaaaagcatttcattgagacgtttacgagcctgtttatgagcgcggcgggcggttcgtcatggtcaatttaatctgggtatgtctgacggtaatcggacttgtctttgcgatgtttaacggtaccttgcaggatgtgaatgaagctgtttttaaaggagcaaaagaagcggttacgatctcgttcggattaatgagcgtgctcgtcttctggctcggcctgatgaaaatagccgagcagtccggccttttggatatattcagcagaatgtgccgcccgtttatctctaagctgtttcccgatattccccctgatcatccggcgatgggatacatcttatcaaatctcatggcaaactttttcggactgggaaatgcggcgacaccgctcggcattaaagccatggagcagatgaaaaagctgaatggaggtaagtctgaggccagccgttccatgattacctttttggcggtaaatacttcgagtattacattgataccgacaaccgtcattgccgtgcgcatggcttattcggcgaaatcaccgaccgatatcgtcgggccgaccatcttagcgactttaatttcgggaatcggcgcgattttcattgaccgctacttctggtaccgccgcaaaagaaaagggaggtaagcgaatggaaatggtgaattggctgtctttagccatgattccgattattatcgccggtatattgatatacggcacgatcaaaaaagtgccgacgtatgaatcattcgttgaaggcggaaaagaaggaattgagattgcgttttccatcattccgtatttggtcgggatgctggtggcgattaccgtattccgggcctcaggcgcgctggattttgtcatggggctgtgcaagcctttctttacagcgctcggcattcccgcagaagtcgtgccgcttgctctgatccgcccgatttcggggacggcggcgctcggcatgacgacagatctgatcgccgtgtacgggcctgattcatttatcggcagactggcctcggtcatgcagggatcgactgatacgacgctgtatgtcctgacggtgtatttcggggcggtcggcatcaaaaaaatgggggatgctttaaaggttggtcttcttgctgatctgatcggggtggttgcatcaatcatcatagttacgttattatttggaagcgcctgaaatcaggcgctttttatatatcagaataactctccttgaaaaagcttgtttgttcaaggggaaaaaagtaagattatacttgaggtgaacgacatggaaagactgcaaaaagttattgctcatgccggcgtggcatcacgcagaaaggcggaagagctgataaaagaaggaaaagtaaaggtgaatggaaaagtaataacagagctcggcgtaaaagtgaccggttctgatcagattgaagtaaacggattaaaggtggagcgggaagaacccgtgtactttctgctttataaaccgagaggagtgatctcagcagctgatgacgacaaagggcggaaagtggtgatcgactttttcaaagaagtgccgcagcgcatttatccgatcggcaggcttgattatgatacgagcggacttttattgctgacaaatgacggcgagtttgccaacaaactcatgcatccgaaatacgaaattgataagacgtacgtcgccaaagtgaaggggattccttccaaggaacttctgagaaagcttgagcgcggcattcagcttgaagaaggcaagacggcgccggccagagcgaaaatgctttccctggacaaaagaaagcagacgagcatcattcagctgacgattcatgaaggccgaaacagacaggtccgccgcatgtttgaggcgatcggtcatgacgtgctgaaactcaaacgtgaagaatacgcatttttagatttaagaggtctgcgcacaggagacgcaagagaattgacgccgcatgaggtgaaaaggctgcgggctttagctgaacacggtaaaaacgctttctaattttcacataaccttcaaaaattacaaaacgtgtagatgatataattgaatggatttgcagacaggggaggggagcagtgtacaatgaacaaaaaacggcggcgtttattcattcggaccggcatccttctcatcttactctgcgcgctcggatataccatctataatgccgtttacacaaacggagagcgtatatctgaggggtccaaagccccgaatttcgcgctgaaagatacagagggcagactcatagaactgagtcagttaaaagggaaaggtgtttttctgaatttctggggaacgtggtgtgagccgtgcaagcaggaatttccctacatggagaatcaatacaagcattttaaagacctcggtgtcgaggtggttgcggtaaatgtcggcgaatcaaaaattgcagtacataattttatgaaaacatacggcgtcaatttcccggttgcgctcgatactgaccggcaagtgctggacgcgtacggcgtatcacctattccgacgacatttttaatcaatcccgacggaaaggtcgtgaaagtggtgaccggcacgatgacagaacgcatggttcatgactatatgaatttaattaagccggaggcgtcttcatgaaaaaggtcaaatgtgagtgcgggcacgtgaatccagccgggacggttttgtgcgagtcgtgcgggaagccgcttgatgatcaaaaatcgccgcttgccgatatgcggtacgacggcagcgcaaggcgttcgcaaacatataacaaaacaatcgtagataaggtatggaacttcttttcttccgtaaaagtcggaatatggctgatcgtcattactctggcggcgtctgctttcggcacggtttttccgcaggaagcttatctgccgccgggcgcccagccggatacatattatgaacagcagtacggcataatcggccaactgtattatttgctggggtttcatcacctgtacggctcatggtggtatatgctcctgatcgcatccattggcatatcactggtcatctgcagcctggatcgggtgattcctttgtacagggcgcttaaaaatcaaggagttcggcggaatccggtctttttgaagaggcagcgtctatacagccggacagaaaccgagctgagcggggatgcggctgatagcctcagaacacgattgaaaaaaaagcattatagagtgcgagaacaagagggaagcatcctggcggaaaaaggccgtttttcaaggtggggaccctatgtcaatcatatcggcctgatcatttttctgatcggagccatgctgagatttgtacccggtatgtatgtcgatgaaacgctctgggtccgtgaaggcgaaaccgcccagatccccggtacagacggcaaatattacttaaaaaacaaccggttcacgatgcagacatataacaaagacactgagaaaaaagtattcaccgacgccattgacagagccggaaacggcaaagtcgccaaatccttcacaacggacgcggttctgtacaagagggaaggcgacattgtattcggtgaaaagccgaagcttaaaagagtcaaagaaaacaatatccgcgtcaatgaaccgctgcgctttgactcctattctgtgtatcaggtggactataaagaaaaccagctcgatcagatggtatttcagctgatcgaccaaaaaacaaaacagtcattcggcaaactgaagatcaatcttcttgatcccgacacggactacgatcttggtaacggttacaaagtgcagatcgccagttatcttcctgatttttattttaaccaagacggagaaccgagcacgaaaaccaaggttcctaacaatccggcttttgtctttaaaatcacggctcccgacaagccgaaaggggagaaaagttttgttgcgattcagcagactgttgaaggttccgaaagtaacaagtacaaattaaaattcgaccatgtggaaacgaaaaacattacaggactcaccgtcagaaaagacttaaccttatgggtgcttgccgtcggcggcgcgatctttatgatcggcgtcattcaagggatgtactggcagcacagaaggatctggatcaaaacaggtgatcatgaagtgcttgtggcgggacatacgaacaaaaactggttcggtctgaaaaaggatatcgaatttgttcttagcgggaccgggattcaagagccggccgatcaaaaagaattggccaaaaatcaggcctagtgaaaaaggagtggtgtcatggcggagctgagcgcaaattttctttatgctgcctttttgatttatttaattgccgtcccggttttcggcggcgccatccggggaacaaaaggtgcgaaggacggtaagggccgctggtcggctatcggaatcacgttaaccattttcggatttctttgtcatctcggctacttcattgcgagatggtcggcaagcggacatgcgcctgtcagcaatatgtttgaatttacgacgtcattcggcatgatgcttgttctcgcttttattattatttactttatttacagactgccttcattaggcatgttcacattgtctatcgcgcttttgcttatcgcatatgcaagcatgtttccgacagacatcacgccgcttattccgtcactgcagagcaattggctgtacattcacgtcacgactgcggcgctcgggcaggcgattcttgcgatcagttttgtagccggcgtcattttcctgttaaagcatgtcgaccaatccagaccgggcaaaaaaacgttctggcttgaagtcatcatgtttatactcgtgacgaccgtggcatttatcgccgtcacgtcggcattccggctggcggactacaaagcagaatttaattgggtggataaaaaagaggctaaaagcgtgatgatatatgatatgcctgcgcttgtcggcccgcatgacggagaactgcttacggaaggcgcaaagaagccgcttattgagcttccggccattttttcaggcagaaaggtcaatacggtgatctggtcgtttggcgcaggtctcgttttatacggggcgctcaggctgatattcagaaagagaatcagcgctcttataagcccgctcgtcaaaaatgtgaatctggacttggtcgatgaagtcggctaccgcgctgtttccatcggttttccggtattcacactcggcgcgcttgtgtttgcgatgatttgggcgcagcttgcatggacgcgtttttggggctgggacccgaaggaagtatgggcgctgatcacctttttattttacgcagcgtatttgcacttgcggctgtcaagaggctggcatggcgaaaagtccgcgtggcttgccgtcattggcttcgccattattatgtttaacttaatttttgtgaatctcgtgcttgccggacttcattcgtacgcatagatgcaaaaagccgatacagttctcaagctgccgcacagtttgttaaaatgaaagtaacagaaggaaagcagggggaaaacgatggatcaaacaaatgaaactaaaatattagtagtagatgatgaagccagaattcgacgccttttaagaatgtaccttgaacgggaaaactatgtgattgaagaagcggaaaacggagacgaggccattaaaatggggctggcatcagattatgatctggtgctcttggatttaatgatgccgggaacggacggaatagaagtatgccggcagctcagagaaaaaaaagcgaccccgattatcatgctgacggcaaaaggggaagaagccaaccgcgtccaagggtttgaagcgggtacggacgattatatcgtcaagcctttcagcccgagagaagtggtgcttcgggtaaaggcgcttttaagaagggcttcccaaacatcttatctgacagccaataccccgacaaaaaatgtactcgtcttctcgcatctatccattgatcatgatgctcacagggtgactgcggacggcacggaggtgagcctgacgccgaaggaatatgaactgctgtacttcctggcgaaaacaccggacaaagtgtacgacagggaaaagcttttaaaagaagtgtggcagtatgaatttttcggagacctcagaacggtggacactcatgtcaaacggctccgtgaaaaattaaacaaagtgtctccgggagcggcgaaaaaaatcgtcaccgtctggggagtcggatacaaatttgaggtaggcgctgaatgaagttttggaaaagcgtagtaggaaagctttggtttaccattctttcactcgtgttaattgttttatttattttaacggtgctgcttctggaatttatagaaaattaccacgttgaagaagcggaaaaagatttaacgcagcttgccgataaaattgcggtcataatagaaaatcatgaagaccagccgcttgccagatccatcacgtgggaactggcggacaatttaacgagcatcgcgatcattcaggatgataagcatgtctggtattcgcccaatgacgataatcatttatcctctattacattagagcagattaaacatgaccgggatctgcacaaggcgctgacagaccgcaataaagtaagcaaacgcgcggtccccaaaaatgccggttcggataacgaacggctgatcgtcggagtgccctatgaaaaagacggcaaaaaaggcatggtctttttatcccaatcgctgcttgccgtcaaagatacgacgaaacatacgacacgctatatttttcttgcggcgggcattgccatcgtcttgacaacgtttttcgcattctttttatccagcagggtgacatatccccttcggaaaatgcgggaaggcgcccaagacttggcgaaaggaaagtttgatacaaaaattccgattctgactcaagatgaaatcggggaactggccattgcctttaatcagatgggacggcagctcaatttccatattaacgcgctgaatcaggaaaaagaacagctgtccaatattttaagcagtatggcagacggggtcatcaccattaatatcgacggcaccattttggtgaccaacccgccggccgaacgttttctgcaggcatggtattatgagcagaacatgaacattaaagaaggagacaaccttccccctgaagcaaaagagctgtttcaaaatgcagtgaacacggaaaaagagcaaatgattgaaatgacgcttcaaggaaggtcatgggttttattgatgtcgcctctttatgcggaatcacacgtccgcggcgccgtggccgtgctccgtgatatgaccgaagagcgcaggctggataaattgcgtgaagacttcattgccaatgtcagtcatgagctcagaaccccgatttctatgctgcagggatacagtgaagcgatagtggacgacattgcaagcaccgaagaggagaaaaaagaaatcgcgcagatcatttatgatgaatctcttcgtatgggccggctcgtcaatgatttactggatttggccagaatggaatccggacatacgggtctgcgctatgaaacggtaaacctgcatgaatttctggagaagatctcccgcaaattttccggtgtagcgaaggaaaaaggcgtttcgctcacagaggacatctcggtgtctcagccggagtgtgtctttgacgaagacaaaatggaacaggtgtttaccaaccttatagataatgcgctgcgccatacggagtcaggcggaaacgttcatatcgcggctcataccgtaaaagacggactgaaaatcgatatcaaagattccggctcgggaataccggaagaggatctgccttttatttttgaacgtttttataaagcggacaaagcaagaacaagaggcagggcagggaccggactcggactcgccatcgtaaaaaatatcgtggaagcccacggcggctcaattgcggttcacagcagcatcgacaaagggacgacgtttacattttatattccgacaaaagcgcaggatgacgtctgaaattgacgaacaatcttgttccatacgaaacacccgcagaacatgcgggtgttttttgtttttttctcctttaaaaatttaagaatatgttaatataaattcccttccaaattccagtttctcgtaatatagttgtaatgtaacttttcaacgcatttttacgacaaaaaagtgaacggaggggtttcccatggaagaaacctttcagatattatacgatgcataccatcaagatttatatcaatttttattttatatggtaaaagataagtcgcaggctgaagatttgacgcaggaagtgtatatccgcgtcttgaattcctatcatacatttgaaggaagaagcagtgaaaaaacatggctgttgtccatcgcacgccatgtggcgattgactggttccgcaagcagcagacgatcagacagcgtattatgggtacgtttgattgggatacacaagatgtcagagatcagcatttgcttccggacgaactcgccgtacagcatgaaaatgtccgggaaatttataccgcgcttgatcattgcaccattgatcaaagagctgttattatcttgagatttattcagggatattccattcaggaaacagccgccgctctccgcttctcggaaagcaaagtcaaaacgacccaacacagagggctcaaaatacttcggaaacagatggagcttttgagggaggagctaatggatgatgaagtcatattggaacgaagaaagagtagaggagttgttaagacaacttccggcggttagagatcatcgttcacccgaggccatttaccggaatattgaaacgggtaaaccgtacaggaaaaaaccggcccgaagctggatcggccccgctgcagccggcatctgcgcattgtgcatcgctctgattatttctcctcacctgatgacaaacaaatctgccggtgatcttacagctgacagcggtcaagctgaaaaagccagtcagtcagctgctgtcaagccggatcagaagacgtttgtcgtttctaacgaaaacaaaaacaattacattactttggcgtttgccgattcagatacatccgccgtcattccggtcagttttgaaaaaaagaagcctgacgaatcggtttcagaggcattatctgatgcaggaaacttagaagtgcccgaatctttcctctctgtgccgaaccttttggacggtgtgcaggtaacggcggataagaaggatttgcttgtgcaggtaaacggacgtctttctatcgaatcagctgccgattctgatttattgaaaaagatgctgaaagagactttgacatggagtccttacgagcggattaaattgaaaaaggttcaaaacggagacggacaggatttttataaatcttacggcatttccgctgagatgtccgtacataaacagacaaaccgggcgtatttttcttacagcgacagtctgggacaagagtatctcatcccgtctgaacaaacctattattcagtatatcaggctattgacgggatgaagacaacagacggaggctcacagaccgcgagcattatagaagcagatgcgattgcatcggtatcggaaagggaagacggcgagcagctgcggatccaattgtccgaaaaacataaagttgaagattcgctggaaggcattttaatgatcgaagggcttttgttaaccgcgaaggaattcggttattctgaggtgctgttcacacatgcgcacgcaaagaaaatcggtaattatgatgtgacaaaaccgattgctgtgcctgccgcgcctaatccgcttccgacccattaaacgtaaaaaaacccaaaacatatgaatgttttgggttttctgttggttacggaaggtcaatcagtttaacggaaacaatatcctgaaccgaagtcagctcattgacgactttatcatctaaatgtttatcaaaagaaagcatcataatggcttctccgcctttttctttacggcccacctgcatggtagcgatattgatatcgttatcgccgaggatgcgtccgacgcgtccgattacaccagtcgtatcctggtgctggatataaacgaggtggccggcaggatttaagtcaatattaaagccgttcagttcaacgattcgttcaccgaagtgagggatatacgtagccgttaacgtaaatgtgctccggtctccggttacttttacgctgatgcagttatcatatcctgattcattggaggaaatcttctcgctgaagctgataccgcgttcttttgctacaccgcccgcgtttacttcattgaccgttgagtctacacgcggttttaagaaaccggacagcaggctttttgtaataaatgatgtttcaagtttggcgatggtgccttcatattgaatcgcaacatctttgacgggttccttcatacattgtgatacgagacttccgattttatcggcaatttggtgataaggctggatttttttgaattcatctttcgtcatcgcaggcaggttgatcgctgacatgacaggcagaccttttgcaaactgcagcacttcttcagaaacctgtgccgcgacattcagctgtgcttctttcgttgaagcgcctaagtgaggtgtggcgatcaccagcggatggtcgggaagctttgattcaactggcggttccacttcaaacacatcaagggcagcgcctgcgacatggccgctttccagcgcttccaaaagcgccgcttcatcaataatgccgcctcttgcgcagttgataagacggacgccttttttcgttttggcaatggtttctctgttaagcaatccttttgtttcctttgttaaaggcgtgtggacggtaatgatatccgcgctttcaagcacttcttcgaatgtccggctgtttacgccgattttgccggctctctcttcggttaagaaaggatcgaatacatgaactgtcataccgaacgctctggcgcgctgggcaatctcgcttccgatccggcccagaccgacaatgcctaaagtctttccgtagagctccgccccgacaaaagccgtccggttccattctcttgattttactgagatattggcttgcgggatgtgtctcattaatgaagaaatcatcgcgaatgtatgctctgccgttgaaatggtgtttccattcggcgcgtttatcacgataactccatgttttgtggcctcatcaatgtcgatgttgtctacgccgacaccggctctgccgacgatttttaaagaagtcatctttttaaacaattcttcggttacttttgtggcactgcggactaacagggcatcaaaggtatgtaattcatcttctgcatccgcgacgtttttttgaacaatttctataaagtctgattccatcagcggctttaagccgtcattgctcatcttatctgagaccaaaactcgaaacattgttagatttcctcctagtttagctgactaaatatctgataatttatcatattctcaatagagtgtcaatgtgtattgacgcagtaaaggagaaaaggaaaccgctgaatcagctgaaattgggcttccccaatattttatttaaatttgagcagttctctatacaattacaatttgatcatatataatgtgaataaattcataagatcaatcttcggggcagggtgaaattccctaccggcggtgatgagcgtcacgctctaagcccgcgagctgcttcggcggcaggatccggtgagattccggagccgacagtatagtctggatgggagaagatggaggttcagcagacgttttgatgcttatatcaaacgtttctttgccaagccttagtaagctcccgctttttaacaaaagcggtttttttattggggcgcaaaagaacctttcctcttttcgagagatttgatcgaaaaggagagagcattgtgaaagtaaaaaaattagttgtcatcagtatgcttagcagtattgcgtttgtgcttatgctgttaaatttcccgtttccggggctgccggattacttgaaaattgatttcagtgacgttcctgcaattatcgctattttggtttacgggcctgcggcggggattgcggttgaagcgattaaaaatattctgcagtatatcattcaaggaagcatggccggcgtgcctgtcgggcaggcagccaattttatcgcggggacgctgtttattctgccgacggcgtttatgtttaaaaagctcaattctgcaaaagggcttgcagtgagcctgctggccggaaccgcggcgatgaccgtgctgatgagtattttgaactatattcttatcctgcccgcgtatacttggtttttacattcaccggcattgtcaaacagccagttgaaaacggcggttgtcgcaggaattctgccgtttaacattgtaaaaggcattatcatcaccatcgtctttacgttcatctttacgaagctgaaaccttggattgaacaaaaacgcagcatccaaacacaataaaggcttaaagcgtccgctctgtgaagaacagccggacgctttttttgtttgtgctgatcggcaaaaaaataagactccggccgataacagccggagtcttattcaggacgaaaaagctcctctcacggggagggcttttttattcgtatttcagcgggtcgccttcgaacggttcatccgcaactttgattgaatcagtagggcatccttcaaatgcgtcaatcatatcttcttccagaacttccggaacttcgacgacacctttattttcgtcaagcgtaacgaacgcaatgccttcatcatcataatcataaatgtctggtgccgcagctccgcaggcgccgcatgcaatacacgtatctttatctacaattgtgtactttgccatgaataaaacctcccagattgttcgtgttggaacaaatggtttaccttatatatttttaaatataacacctattcctcttacttattgtaatgatgttagtgtcaaatttcaacagaaaaatgattgagaatgcttatcacataagggattctctttagcacttccccctaaaagatgactttaaacgtcaaatttatatgaaaatctgttaaaataaaaagaaccaaaaaacgaaacttgtcacaaaagaaatgtaggtgtgtttagattggcgataaactactttgataccgtggttctcgactgtctggacaaaatagacggcgaacggactccgagtgctgtgtttcatttattaaaaggaaaaaagtcgtctcaaaccattcaggatgccggcttatttcagatcgctaaatatttcggcatggcttcacagtgtgaacgcggcgatattgcggcttctatgcatagactcaccgagaactcatacatcacagccggaaaagaagagggaacgcggaaagtgactgcgcgcggcgttcaaaggcttgaacgggcgtttgctgagcggccttggccgaagcactgccacggcgcaaattatcaaacgcctgccgtcatcctgtggaggcggctttctctgctcattcaagtcctgtcaaacaaagagcatcaatgcagtcaatatatcccggttaccaacgatgtgcagacgctgagatgggtcaaatggttcatgcggaaaaacagagatgctaaagagctttccgtccaaatgcatgacgcgctgtttcagcttctgcaaggcgtaagtgaacggcaggcgcttatttttgtctattctttaacttcattcaacagaatcggcaaaacgaataagcagctcgctctccagctgaacgaagatgaatggtatgtgtccgtccagttttggggagcggtacattatgttattcaatcgcttccgcaatgtgcatatcccgctctgcgcgagctgttgtccgatctgcaggcggaaagcgcgctgacacagtctgccagaaaaacctttgagctgttggaaaaagggtttccgattgaacggatcgccgcggtcagaaatttaaaaaccgccacaatcgaagatcatatcgtagaaatatcattgcatcagcctgcattttttatagaacagtatctttctgaagaggaacagcgtatgataacggcatttgcaaaacagcatcaaacaaataaaattaaacggattcgcgaaggaatgcagatgcgcttcagctatttccagatcaggctggcgctggcaaagacggtgaatcagcatgactgagctgcataaagctttatccagatattttggtttgcattcctttaaaaaagggcaggaagagattatgactagcgtgctccaaaaaaaggatacgatcgccatgcttccgaccggcggggggaaatcattatgctatcagctcccgggttacatgatggacgggctggtgctgattatttcaccgcttctttcattaatggaagatcaggtgcagcagctgaaagcaaaaggagaaaagcgggttgcggcattaaacagcatgctgaattccgcagagcggcattttattctcagcaacatcagccggtataaatttctctatatgtctcctgaagccctttcttcaccttatgtactgaaccgtttgaaaaacgttccggtcagtttatttgttattgatgaggctcattgcatatcggaatggggacatgatttcaggcctgattattcgaagctcgggcctttcagacaggcactcggaaagccgcctgtattggcgctgactgcaacagcgacaaaagaaacgctcagagacgtgacggatgtgctcggacttgagcatgcggtgcgtcatctttattcagtcaaccggccgaatattctcctggcggcagaacatttggctgataatgccgaaaaaataaacaggctcacggagcttgccgaaaagcttgaaggccccggtatcatatattgtccgaccagaaaatgggcggaagagcttgcggctgagctgaatgaaaaaacgggaaagcggacggattattatcacggcggaatggatacaggggacagaatcttgatccagcagcaatttatccataaccagcttgattgcatctgctgtaccaatgcgttcggcatgggtgtggataagtcagatatccgctttgtcattcacttttatcctccccaaacggctgagggctttatgcaggaaatcggcagagcgggacgcgacggcagcccgagtgtcagtattttgctgagggcgcccggcgataccgagcttcagcagcagattattcagacagaaagcctgtctgattatgatctggaaggcattttggccgtcatacgggatgccggtacggatgatgagcgaaagcttcgggacgttctgatcaataaaggcgtccaggaaacacaggcgcgaacggccgtccatctgtatctgcaaggaaaaaccacaaaagagcagctgcaggaagaactgacataccgcgtggaaaagaagctgcgtaaaatgaaccgtttttcggcgttattagagcggaaagaatgtataagaaaagcgctgctgtcttattttgatgaatcgtatgagcctgaaggccaaaccggacaatgctgcagcagctgcggacttgatctggctccgtacgagcaaaaaggagaacggaaaaacatggaacggtttgaagattggaagctggaattaggccggattttcggttcagagtctgcgggtgagttcagctgagacggcaaagcgaattgatccagcagctctcagaccgggagattgtgatacagctgtatgccacccaattgctcatattggcggtttcagctgttatcggctttttctttttcaccgacattcacgattttttaaagctgtggcatatacgtgacgataatatcatatggtacggtgtaactcttgccgtccttgtcatttttgccgatctggcggtgatgaaatggtgtccttcgcatttatatgatgacggcggcattaatgtattgctttttaagaacaggccggttctgcacattttgtttttgacgcttctcatttcgttcagcgaagagattttgttcagaggcgttctgcagacacatatcggcttatgggccgccagcttcatttttaccgtgcttcatttcagatacttggcgaagtggcttctgtttatgatggttgcgggcatcagtcttttgctggggcttatctatgaatggaccggcaatttattcgttccggttacagcgcattttattattgatgcggtatttgcctgtcagatccgttttcaatatgttaggaggggtttgcatgacggaaatgtcaagagttgaaagaagaaaagctcagcagcgtgccgagcagcaggttgccgcggccgcggatgaacaaattgaatatcttgaagacagcctcccgacaagacaatctgtaaaagaggagcgtaaaaaaaaggaagagcaggtgaaggaaaaaaccaaaacaaaaacgccgctgttcacttttctgaccgtcctgttcattatcgtaacaatcggtgtctttttcggtcttctttatatgacgaacagcagcagatttgacccgaaggactatgaagatgtcttcatagaccacagtgaaagcgcgcctgccgttattccgaaaggcgctcagaaagatacgtcagaaaccgctcttttagaacaaccgaaaaaaaagtctgacgacaaagataagaaagaagcggctgcatctgaaaaaacaaaagaaaaaccaagtgaaaaaacacctgaaaaaacggaaacgtcctcagaaaaacaagtaaagccgacagacaccgaatacgcggagacaaaacagcagtctccgccggctgtccgtgaaaaagcggctccggctgccgcaagtgatcaagctgggactgtcccgaaaaaagtgcggaccgtacagcatactgtacagccgaaagaaacgctttaccgcatttcaatgaaatattataaaagccgggcgggcgaagaaaaaatccgcagctacaacggattaaacggaaacgacgtgtacaccggccaggttctgaacattccgctgtctgattaaaataaatgcatgttttcaccgcgtttttcatatagtgtactaatgaaaacggacaaggtgtgaagcgcatggattctttatggaagcaattagaccgatttgctgacggaccgacgaaacaaatgcttcaggcgctggtgaaacggaaattaaaatacgaaaattatgccgcacaatgccgaagatggcagtgggcgtccctcgtttgtttttccctgatgtgcatactgctgatgtttaaaagctttaatgccccccaagcctctccgcagctgattctgcaggaaatattaggccatacggtttatttgtgctggattatggcttccgcttttgcgtattgcacttcttattattttaaaaaaaaggaagaaaaagctgagggtgaatttcataaactgagatgtgaaattatccaaaaaagcacggatttatggccccagcctgaaaaatggagggcgagagaatctgtttttcacttgatgaaacatcggtatgatatcaatctttattttgaaagcaaataaaatgaggcgttttccggaaaggatagaaacgtctttttttgtttgtccgtctaatgtaagacaatgacagaatggagagtgcgtttatgaagctaacagcgggaattctcggctcattggcgggagcggctgcggttatggcggccgtcatgtacaaaacggcaaacggcagccatctgaaaacacatacatttacgcttgataaaatgaaagggatgaagccgctcaccatcttctttatatctgacgtgcaccgccgtttaattgatgaaaagcttctccgcgaagcggcagtttataagccggatgccgttttgctcggcggtgatttggcggagggcggagttccttacgccagaattgaagaaaacatcaaacgtctgacggctctcgcgcctgtcatttatgtgtggggaaataatgattacgaggtcagccagcaaaaattgctctcacttttacgggcatacaaagtgattccgctgagaaatgaatcggttcagtttgcttataaaggggaaaccgttacgatctgcggggtggatgatatcaggatgatgatggatgattacgaagctgcaatcagatatacggatgctgataaagtaaaccttctgctttgccataaccccgacatccatgagcagatgagggagtcagacgggattgacgctgtgttcagcggccatacgcatggcggccaaatccgtttcggccggttcgggccgtacgaattgggcggggcgggaacggtaaaaaaagcgcattatctgatcagcaacggctacgggacgacaaaagttccgctgaggctcggggcgaagccggagacgcatatgattacgctgtgcgggccggatgagccgttttcctgaaacaaatccggccgcggtgataaaaaacggcattctgcttgtcttcccgctgtacacggtgtaaactgataacaaattaagaacctatgactcatttattcatatactgtgttatatgatttgtgtgcaagaagaggcaggagggaacattatgcggcttgagcgtctgaactataataagattaaaatctttttaaccctcgacgatctgactgatcggggactgacaaaagaagacctctggaaggactcgtttaaagtccaccagttatttaaagatatgatgaatgaagcaaatacagagctcggctttgaagcgaatggtccgatcgcggtggaagtatattctcttcaggcacaaggtatggttgtgattgtaacgaaaaatcatgacgcggacgcagaagatgacgaatatgacgatgattatatcgagatgcaggtcaaacttgacgaaagcccggatattatttatcagttccattcgtttgaagatatcattcagcttgccggaagccttcaccgcatcgggattaccggcggcaccgtctaccattatgagaaccaatactatgtaagccttgaagacctcggctcccgttccgccgaaggtgtcatcgcggtgctggctgaatacggacacccggcgacaattacgatttacaggctccatgagtacggaaaactcatcatggacggcaatgctgtggaaaccatccagaaacatttttcataaaaaagatttgaaacggcagctgttttcagcggccgtctttttttaagcgaaataatggaaaaatcattgtctttcttctatgcacggagatattgaaggtgtatactagtcactgaaagggagcatgagagaaacagaagattttaggaggttaactcaaatggcagccgatcgattcaccggtcataatgaagaagacaaacatgatgtattaaaatcaacccaaaccgtaatacataaagctctggaaaaattggggtatccagaagaagtgtatgaactgctgaaagagccgctcagattattaacggttaaaattcctgttcggatggatgacgggtctgtgaaaatatttacaggctatcgtgcgcagcacaatgattccgtaggtccgacaaaaggcggcattcgttttcacccgaatgtaactgaaaaagaggtgaaagcactttccatctggatgagtttaaaatgcggaattattgatcttccttatggcggtggtaaaggcggaattgtttgtgatccgagaaatatgtcattcagagagcttgaaaggctgagcaggggatatgtaagagcaatcagtcagattgtcggaccgactaaagacgtcccggcacctgacgtatttacaaactcacagattatggcttggatgatggatgaatattcaagaattgatgaatttaactcacccggctttattacgggaaaaccgcttgtactcggcggatcccacggcagggaatcagcgacggcaaaaggcgtcaccatctgcataaaagaagcggctaagaaaaaaggtctcgatattcagaacgcgcgtgtcgtcgtacaaggtttcggaaatgcgggcagctatctggccaagtttatgcatgacgccggcgcgaaagttgtcggaatttctgacgcgtacggaggcctttacgatccggacggtcttgatattgattatctgcttgaccgcagagacagcttcggaacggtgacgaagcttttcaatgacaccattacgaatcaggagctgcttgagctggactgtgatatacttgtcccggcggcgatcgaaaaccaaattacagaagaaaacgctgaccgcatcaaagcgaaaatcgtggtagaagcggcaaacggaccgacgacactggaaggaacgaaaatcctgacagacaaaggaacgctgctggttcccgatgttctggcgagcgccggcggtgtaacggtttcttatttcgaatgggttcaaaacaaccagggcttctactggagtgaagaagaagtcgaggaaaaactggaaaatatgatgataaaatcgtttaataatatttatgaaatgtcccaaaaccgccggattgacatgaggcttgcggcttacatggtcggcgtgcggaaaatggctgaggcttcgcgtttcagaggctggatataaaccaatcgtttgcataaacaaaaaaaatctcctatgataatataggagattttttatatgagtggaaacttatgatggaaatgccaatcgcaggagttgaaggacatgacagaagaaaaagcaattataataggcggaggtccttgcggattatcggcggctatacatctgaagcaaattggcgtgaacgcgcttgtgatcgaaaaagggaatgtcgtaaacagcatttataactatccgacgcaccaaacttttttcagttcaagtgaaaaattggagatcggcgatgtcgcctttattacggaaaacagaaaaccggtccgaatacaggctctctcttactacagagaggttgtcagaagaaaagagctgcgcgtaaacgcctttgaaacggtggagcgcgtaacgaaacaggaagacggccgttttcttgtagaaacgtcaaaagaccgctacctcactccgttttgtatcattgcgacaggatattatgatcatccgaattatatgaacataccgggtgaagggcttcctaaggtatttcattactttaaagaaggccatccttattttgataaagatgttgctgtgatcggcgggaaaaactcaagtgtggacgcggctttggaactcgtgaagtccggtgcgcgcgtcacggtgctctacagaggacatgagtattccccgagcatcaagccgtggattctgcctgagtttgaggcccttgtcagaaacggcacaatccggatggaattcggcgcttgtcttgaagaagtgacggaagatgaaatcattttccgctccggccgaaatgagacggtccggctgaaaaacgatttcgtatttgccatgacgggataccatcccgatcacggtttcctcgaaaaaatcggtgtgcagattgatgctgaatcaggccggccgtttttccgggaagaaacgatggaaacaaatgttgacggtgtttttatcgccggagtcattgcggctggaaataacgccaatgaaatttttatcgagaacggccgttttcacggcggcttgatcgcaaacgaaatatcaaaacggctgggtgcagagagcatatgatcattcatatgctcttttttaaaaaattgaaagatgtaaaaatatgaacaacatggtaccatagatataggaatataaaggaaagaggttgcctgatgtttgcaatcatctctgcaggaattgctcccggcattgcgctgttaagctatttttatttaaaagatcagtatgacaatgaacctgtacatatggtgctgaggtctttttttctcggggttgtccttgtgtttccgaccatgtttatccaatatgttcttgaaaaagagcatgtggggggaggaagctttttcgtttcgtttttgtcttcgggatttttggaagaatcggtgaaatggttcgttctgatgatcagtgtgtacccgcatgctcattttgatgagcattatgacggaatcgtttacggggccagtgtgtctttaggctttgccacgcttgaaaatattctgtatttattcggccacggcgttgagcatgcttttataagagcgcttctgccggtctcctgccatgcgctgatcggagtgattatgggattttatctcggaaaagcccgcttttcgcagaaaaaagcccgtgtcaaatggcttgtgatttcgctggccgtgccttcatgtctgcacggttcttacgattttattcttaccgccctcaatcattgggtatattatatgctgccgtttatgctgtttttatggtggttcgggctgcgaaaggcaaaaaaagcacgctccgtcaatatgatccaagtgtgaagaaaccgcgcatcgcgtgcggtttctttttttatgccttgatgagggataagaaggaaacggtgtataaaaatatccgcgtgacagacaatacgggtacactttaaattttgcagtaggaggcttgaagagatgaagtgcaaaggagcctttatggcatgtctcattctattttctttcgccgccgctttcttcgatcatcatgaaacggttcatgcgttttcaaatcaagtgattcaaagaggcgcgacgggtgatgatgttatagaattgcaggcccgtcttcaatataacggattttataacgggaaaatcgatggtgtttacggctggaccacatactgggccgtgagaaattttcaggagaaattcggcatgaagccggttgacggcctcgtcggggcgaaaaccaaacaggtgctgatttcaaaatcaaaatattaccgtgaatatgtaatggagcagatccaaaaagggaatacgttcactcattatggcaacgtcccattggaaaaccaaacaaaaccgagagccggagcgcagaagcctgcggaaacgaataagcctgctcaaaagccgcaaaacaatacaggcggtcagtcaaatcaaaagcaaaatacgacagcggctaatatgcctggcggtttctcaaacaacgacatcaatcttctggcgcaggctgtgtacggggaagcgcgcggtgagccgtttgaaggacaggttgccattgccgcggttattttaaaccgtattaaaagcccgttatttccgaatacggtggccggcgtcattttcgaaccgctcgcgtttaccgccgttgccgacggccaaatatacatgcagccgaatgaaagagcaaaagaagcggttcttgatgcgattaacggatgggacccttctgaaaacgcgctttattatttcaatcctgatacggcgacaagcaaatggatttggggacgtccgcagattaaaagaatcggaaagcacattttctgtgagtaaaagtacgcaaaatgaggtgttaacatgattagaggaatcattatcgctgttctcggtgtcgcgatcgccgcaaccggatactggggatataaagagcatcaggaaaaagatgcggtccttctgcacgcggaaaataattatcagagggcttttcatgaactgacgtaccatgttgatcagcttcacgacaaaatcgggacgacgcttgcgatgaacagtaaaaaatctctgtctccggcgctcattgatgtatggagaattacatctgaagcgcataacaatgtgagccagctgcccctgactctcatgccttttaataagacggaggagtttttatccaatataggagatttcagctataaaacatccgtccgggatttagaccaaaaaccgcttgataagaaagaatatacaacactgaacagcctgtacaaacaggcggagaacattcaaaaccagcttcgcagcgttcagcatctcgtcatgagcaaaaatttacggtggatggatgttgaaatggcgctcgcctctgacaaaaaacaaagcgataatacgatcgtcgacagctttaaaacagtcgaaaaaaatgtaggcgctttttctgaagacagcatcagccccacatttacgggagcaaatacagaacgaaaaggttttacgcatctgaaaggaaaacaaattacggaaaaagaagcggtaaaaatcgcacaacggtttgcgcctgatcataattattccattaaagtggtcaaaagcggccggaagacgaatcgcgatgtatacagtatccgcatgaatgacgcggatcacaaatcttttatctatatggatattacccaaaaagggggacatcctgtctatttgattcaaaaacgggccgtgaagaaacaaaagatcagcctcaatgaagcatctaaccgggctgtcgcgtttttaaagaaaaacggatatgaaacaaaaggtctcgaaattgatgaaagcgcgcaatataataacatcggcgtcttttcttttattcccgtggagaaaaacgtccgcatttatccggaagccatccgaatgaaagtggcgctggatgatggtgaagtcgtcggtttttccgcgcgtgattacctggcggcgcaccgcacgagaacgattccggctcccgctttgtcagctgatgaagcgaaagcgaagctgaataaaaatgttgaagtgcgggagacccggcaggcgctgatcacgaatgaactcggtcaggaagtgctttgctacgaaatgctcgggacgatcgggaaagacacgtatcaaatgttcattaatgcggacgacggaaaagaggaaaaaatagaaaaattaaaaagcgcagagcctatatataaagacctataaaaataaaggaggaaaggactaaaagtcttttcctttttttcattacatgctttaataaaagcataaataatgaaagagtgaaggccatgatagctgtcggagattatatttggattgaatacatagagaacaatgagcccaaaaaagcgaggagtaaagcagtaagcgttgaaaacggcgaactccacatctcatatcccgtcgatctggattcgggacggacggtctttttgcataaaggattggaaataacagcggaatttatggggaatggccaagtaccgtatcaatttaaaagcataattaaaggaaagaaaaaagaacccatcccgatgatcggattggacatcccccctcaggaggaaatgaagcggattcaaagacgccgatacgtccgtgcagacgcagtattggatgtatccgtcaaattggaagagaaaaaaaccgcttttcaaacggtttcctctaatatcagcgccggcggaatcgctgttgtgatgcctgagcatatttccgcggaaccaggtgaaaagctgtatgtctcattttctcttcccggcaaggaaaatggggcggatataacggccgaggctcttacccagcggattttttatgatgaaaaggcggataaacaaaaaatgacgcttgaatttacagaaatcggccccgcagcacagcagcttttactccaatattgtatgcgcgcgcagctgcagcagagaagaaacagtctgtcggaataaacagcagcgcacttttccatactaatcctaatggaggtgcgcgtgtatgaaaacatttgaacgtctgctggtcaaattggtctgcattcagcttataattttgggcgcggtgcagtttttgcttcattatcagcctattgaaccttatatttcgaaagctgtgaaatatgagggagttgataaaatggagaaaaaagaatggattgaaacggtaaagcggtaaatcagctcaattttttcgccccttttccggcagttcatgatacaatccatagaggagtaaagagcaaggagagagattatggacaagaaattatcaattgcgatcgacgggccggccgctgccggaaaaagcaccgttgctaaaatagtagctgagaaaaaatcatatgtgtacattgatacaggggcgatgtatcgtgccattacatatacggcactcaagcagaatgccgatttaaccgatgaagccgcgcttacagagcttttgaagcgtacggaaattgagcttgtatccgctccggaaagacaaatcgttctcgtaaacggagaagatgtgacagaagaaatccgaaaagacgaagtcagcaaccaagtatccatcgccgccaagcataaaggcgtcagagaagaaatggtcaaaagacagcagcagctcggacaaaaaggcggtgtcgtcatggacggccgtgatatcggtactcacgtgctgcctgatgccgaagtgaaaatttttctgctcgcgtccgtagaggaaagagcgaagcgccgatatgaagagaataagaaaaaaggctatgacgtgaattacgagacgctcattgaagaaattgccagacgcgacaaactcgattcagagagggaagtttccccgctgcgcaaagcggaagacgcgattgaaatcgatacgacgtcactcagcattgccgaagtcgcaggaaaaattctggagatcgtcgaacagaaatcacgttaacttcgggcggagcgctttttaatttttttcaaaagacaagatgttattgcttgacaaaccagtccttttattagaagttaatactaataaaactttttattgatcattcaaaatcttttttggatgattctttaatacatattcggctgaaaagcggacattcacatgttcagctttcaaaccgtattaattaagctgtgtaggtttggaccaaggaggttattcaaatgacagaggaaatgaatcaaattgatgttcaagtgccagaggttggagatgtagtaaaagggattgtgacaaaggtagaggacaagcatgtagatgtcgaaattgtcaatgtcaaacagtccggaatcattccaatcagtgaattatcaagtcttcatgtagagaaagcatcggatgtcgtaaaagttgacgacgagcttgacctgaaagtaacaaaagtggaagacgatgctttgattttatctaaacgtgccgttgatgctgaccgcgcttgggaagaccttgaaaaaaaattcgacacaaaagaagtgtttgaagctgaagtgaaagatgtggtgaaaggcggtctcgtcgttgatatcggcgttcgcggcttcattcccgcatcacttgtcgaagctcatttcgtcgaggatttcactgactataaagggaaaaccctctctcttatcgtcgttgaactcgaccgtgataaaaaccgggtgattctgtcacaccgggctgtagtggaaaaagaacagacagccaaaaagcatgattttctccaaacgcttgaggttggaagcgtgcttgaaggaaaagtgcagcgtctgactgatttcggcgcatttgtcgacatcggcggaattgacgggcttgttcatatttcgcagctgtctcattcacacgtcgaaaaaccgtctgacgtggtggaagaaggtcaggacgtaaaagtgaaagtgctgtccgtagaccgcgataacgagcgtatttctttatctattaaagaaacgctgccgggaccttggagccagatcggcgaaaaggtaaaacagggagatgtgcttgaaggaaaagtgcagcgccttgtaagcttcggcgccttcgttgaaattcttccgggcgtggaaggacttgtgcacatttcgcaaatttccaataaacatatcggaacgccgcatgaagtgcttgaagaaggacagactgttaaagtgaaagtgcttgacgtgaacgaaagcgaagagcgcatttccttaagcatgcgtgagcttgaagaagcgccgaaagccgatcaggaggacttccgtcaataccaggcgaaagaagagccgagcaccggcttccagcttggcgatttaatcggagacaagctaaataaattaaaataaattggtgataaaacgtgacacgagcagaacgaaaaagagaacatataaatcatgcgctgtctaccggccaaaaccgggaaacggggcttgatgatattacgtttgttcatgtcagcctaccgaacctagcattggaaaaagtggatatatcaacgaaaatcggcggactcacaagcagttcgccgatttttatcaatgcgatgacaggcggcggcggacagcttacatacgaaattaacagatcgctggcaagagccgcgcgcaaagccggcatgccgctggctgtcggttcgcaaatgtcggctttaaaagatccctccgaacggtattcttacgagatcgtcagaaaagagaatccggacgggctgatatttgccaatttaggcagcgaggcggatgccgagcaggcaaaaagagcaattgatatgattcaagcggatgccctccagattcatttaaatgtgattcaggagatcgtcatgccggagggagacagaagctttaccggcgctctcggccgtattgagcggattgcggcggaagcgggagttcccgtttttgtcaaagaagtcggcttcggaatgagcagggagtcggcacggcagttatttgatgccggtgcggcagcagttgatgccggcggatacggcggtacaaatttctctaagattgaaaatatgcgcagagagaaggcgcttcaattttttaatacgtggggaatttccactgccgcaagcttagcggaaatccactcgctctccgctgatcaatcaattatcgcatccggcgggctgcaaagtgccttggatgtcgccaaatcgattgccctcggcgcttctggcgcgggaatggccggcaccttcctgaaagctctcacctccaacggagaagaggggctgtttgacgagatgacggcgcttttacaagagctgaaaatgattatgaccgccctcgggtgccaatcggttgcccaattgcaaaaggcgcctttggtcataaaaggtgacacacatcactggctttcggaacgggggattgacacatcccgtttcagcagacgttaaaaggcatgcgaacccgcatgcctttctctgttttttacgattttctttttcggaattcaccgttttgttcaaggctcgtcgctcctttatggtgaattgaatcatcgcgatcagattccacccggcgggaggctttcagttttttctcctgtctgtcttttcccatttttatccgctcctttcaggcataattggtttaaaaaatgcgttcccgctccatactggtcagaggaggagcgattatggaaccgttttattattactggtcaatgtggtttttatggatacttgcgacttttatttttgccaaaacaaaaagccgtttttacgtatcagtctttattttgactaatatgatggcaagcatacatcagataacggcttattttacgctgaacgcggcatatgtcatgttttttgctgcggcatttgtttatgcgggaagcctcggcatgcataaacggctccgtcatattgtgattcatctgacggcggctgcggcgtacggctttatttttctttttgcattatatgaccctgtttggtttatcataaaacctgaatgggcagcggttatactgcttaccgttattacgctttctgttgaggggcggttccctgagaggctttgtctttttgttctcggcatgtgccagggggagttattgtatgctgcggtcatccgcaacattgcgggggcagcagccgtcggtgattataaatggctatcaggctgttcggcgggagtgattcttctcgtcgggctgactacatatgaacagcttgcggcgcgcatcagccaaaaaagcaaaaagcagggcaaaggagcgacaaaaatgtcttgaaaacagacggagactgttacatgaatgcgaaacattttgaagaatacattgtgatctcagtgaaaactgatataataaatgagttaagcccttctgtttgaagggttcttttcatagcgaagatgattattaataaccggttgaacaattttttgtgaaaatgtaagcggctggattgaaaggaagggtactatgggtaaacctgtcgtagccattgtcggaagaccgaatgtgggaaaatccacaatctttaaccggattgcgggtgaaagaatttcaatagtagaagatacccccggagtgacgcgggaccggatatacagttcggcggaatggctgaattatgattttaacctgattgatacgggcggaattgatatcggagacgagccgtttctgacacagatccgccagcaggctgaaattgccatggacgaggctgatgtgatcatctttatggtgaacggccgcgaaggtgtgacgtctgcggatgaagaagtggcaaaaatactgtaccggacgaaaaaaccggtcgtattagccgttaataaattagataataccgaaatgagagcgaacatttatgacttttatgcgctcggctttggagaaccgtatccgatttcggggacacacggtttaggattgggagatttgctcgatgcttgtgccgagcattttaaaaacattccggagacgaagtacagtgatgatgtcgttcaattctgcctgatcggccgcccgaatgtcggaaaatcatcccttgtcaatgcgatgctcggcgaagagcgggttatcgtgagcaacgtagccggaacgactagagacgctgtggatacggcgttcacttacaatcagcaggaatttgtaatcgttgacacggcgggaatgagaaaaaagggtaaagtatatgaaacaacagaaaaatacagtgtgctgcgggcgttaaaagccattgaccgctcagacgtcgtcggcgttgtgctgaatgcagaagaaggcatccttgagcaggacaagcggatcgccggatacgcccatgaagccgggaaagccgtcgtcattatcgtaaacaaatgggatgccgttgataaggacgagcgcacgatgaaagaatttgaacagaatattcgggagcatttccaatttctcgattatgcgccggtgctgtttatgtcggcactgacgacaaagcggattcatacactcatgcctgcgattattaaagcgagtgaaaaccactctctccgcgtgcagacaaatgtcttaaatgatgtcatcatggatgcggtcgccatgaatccgactccgacgcacaacggctcccgtctgaaaatttattatgcgactcaagtcgctgttaagccgccgagcttcgttgtttttgtcaacgatccggaactgatgcatttttcttatgaacgctttttagaaaaccgaatccgggacgctttcggatttgaaggtacgccaattaaaatatttgcaagagcaagaaaataaaaaggtgtgatacagagatgaaaaaagtggcaatgcttggagcgggaagctggggcactgcactttctttagtgctggctgataacggacatcaagtcatgatgtggggacaccgtgccgaattgatcgatcaaatcaacgaactgcatgaaaacaaagattacctgccgggtgtggagctatcaagttctatcatcgggacagccgatttaagcgaggctttaaaaggagctgacttcatcattgtggcagtaccgacaaaagccattcgggaagtgctgaaaaaggctctgccgtacatcccgaaacaatcgatttttgttcatgtcagcaagggaattgagccggattcgcttctccgcatttcagaattaatggaggaggagctgcctgaggagtacagaaaagacatcgtcgtgctttcagggccgagccacgctgaggaagtcggattaagacacccgacgactgttacatcatcttcaaaaaatatcaaggctgcagaagcggttcaggatttattcatgaaccagcatttccgcgtctatacaaatcccgatatgatcggtgttgaaatagggggagcgttaaaaaatatcatcgctcttgcagcggggattacagacggattgggatacggagataatgcaaaagcggccttaatcacccgaggtcttgctgaaatcgccagactcggcacaaagatgggcggaaatccgctcaccttttccggcctgaccggcgtaggcgatttaatcgtgacgtgtacaagcgttcattcccgaaactggcgcgccggcaacctgctcggcaaaggatataagctggaagctgtcctggataagatggggatggttgttgaaggcgtgcggacgacgaaagctgcgtatcagctgtctcaaaaatatcaggtgaaaatgccgatcacagaagcgcttcaccaagtattatttaatgggcagaaggtagaaactgccgtagaatccttaatggccagagtgaaaacccatgagatggaagacttggtcaacacattcgaaaaccgggtgaagtgacaataacatgccgtcagcatattctgaagtgacgaaagtacaaaacgcagaactctccggctgaaatcgcttaaaacatttgctgatttaggcagaagaggatgcagacgtacgcatctacgcatactatagcatcgaagtccaagagagtgtatctcagacgtacaggtgaatatagtcaacttgactgaagcaaagtccccctctttgcttcagtttttttgttttttcaatagatggaaaacctgttgatcttttcaacatttgtatattaaaatgaaatataacgcttacaatgatgggacggggggcacgaacttgagtgtggcattgatgaaaatgtggtttgcgcttggtgctatgggattaatgtttgttgcggtcgcctctatttatgtcagcaggtacaaagtgaaaaacaaactgataaaagcagcggtttcttcactcgcttatgcctgcatggtcatctcgggattgatcgtgttaatggtcgttttcagcgggcctgtcaatgaataaagccaaaagggggcgcggaatgcataagttaaaaatggccgtcataacggcaatggcggtgcttctgctgtcgggctgtctgtaccctgaagcaaaaaaaactgaaaataaagtatcttacaaacatcagcttcagcaggtgcaagcggcagtggatgaatttaaaaaggcgaacggcggacttctgccgattcagacaaaagatatgaaaacaccgctctatcaaaaatatccgatagattttaagcggctcgcgcccagatacatcgaggagccgccggcctcagcttatgaaagcggaggaatgtaccaatacgtgcttgtcgatgtggaaaataagccgaccgtcaagctggtcgatctccaaatggcggaagcaatccgcgacatgaagctgcgtgtcaaaatgtatcaggaaaagcatacatatcctccctatgaggacgctgtttcaaaaggcctgttcactttaaataaaaaaaagctcggcatgaaagactctccttcagtcaaaagtccggtttcaggcacgtctctgccgcttttaatcggcgctgacggagaaatctatgccgactatcgcgtcgatctcgcccgctgcttgaaggaaaacaaaaagaaaatcaaaccgggcgcggaaattcaggatattttatggaaagagactcctttcgtcccggccttttcagtcacttacaccgtaaatgaaaaacaggaacccgtttttttagaaagtcaaacgaaacaggaatgaacctttttcccgcgcatacaaatagggagaaaggttttttttgattttgatagaaaagattgcctgaaaattttctaaagatgtcatattgaaataggacaacgtcatacacatatagtgtcctgtatttgattggagaatggtgaatgaaaaatgataaggataggaagtccgggaggggatcacttggaaaaggtcgatattttcaaggatatcgctgaacgaacaggaggcgatatatacttaggagtcgttggcgctgtccgtacagggaaatctacattcattaaaaaatttatggagcttgtggtgctcccgaatatcagcaatgaggccgaccgagcgcgggcgcaggatgagcttccgcaaagcgcagcaggaaaaacgataatgaccacagaaccaaaatttgtcccgaatcaagccatgtccgttcatgtcgcggaaggacttgatgtcaacatccgtcttgtggattgtgtgggatatacggttcccggggcgaagggatatgaggatgaaaacggtccgagaatgatcaatacaccttggtatgaagaaccgattccctttcatgaggctgcggaaatcggtacgagaaaagtcatccaggaacactccacaatcggggtcgtcattacgacagacggctcaatcggcgatattgcgcggggcgattacgtggaagcggaagaaagagtcatcgacgagctgaaggaagtcggcaaaccgtttattatggtcatcaactcggtaaaaccgtaccacccggaaacagaagcgctcagagctgaattaagcgcgaaatatgatattcccgtcctcgccatgagtgttgaaagcatgcgggaaacagatgtgttaagcgtcctcagagaagcgctttacgagttccctgtgctggaagtcaatgtcaaccttccgagctgggtcatggtgctgaaagaaaatcattggctcagagagagctaccaggaatcagtgaaagaaaccgtaaaagatattaaacgcctgcgcgatgtcgaccgggttgtcggccacttcagtgaatttgagtttattgaaagcgccggattggccggaatcgaacttggccagggtgtcgcagaaattgatttgtatgcgccggatcatttatatgaccagattttaaaagaagtggtcggcgttgaaatccgcgggaaagaccacctgcttgaattaatgcaggacttcgcccacgcgaaaaaagaatatgatcaggtatcagatgcgctgaaaatggtgaaacagaccggctacggcattgccgccccggccttaaccgatatgagccttgatgaaccggaaatcatcaggcagggatcaaggttcggagtaaggctgaaagcggtcgctccgtccattcatatgatcaaagtggatgtggaaagtgaattcgcaccgatcatcgggacagaaaaacaaagtgaagagcttgtccgctacttaatgcaggactttgaagatgatccgctttctatctggaattccgatattttcggcagatcattgagctctatcgtaagagaaggaatctccgcaaaactgtcactcatgccggaaaatgcgagatacaaactgaaagaaacgctggagagaattattaacgaaggctcaggcggcctgatcgccattattttgtaagctgaaggacctcttcctgaaacggggggtctttttttattctttttagatactggaaatcaatcaaggattaggaggaaaaaagcaaaaaaaggaatatttgttcggtaaaacacgtgaaaaccttgacgagcaagggattgaggctttaaaatgcttgatatggctttttatatgtgttactctacatacagaaaatcttcactttgttggacaaacattcctcaaagtgtctgttttcttatgaaaagccgtttacttgtctgttcttccctgctttgattttttatcagacaggtttagaatcaggctgaactgtgaagaaatgataataaactgctgatttgatacccttttgggaggaggtgaaaggcatgaacaagacagaactaatcaatgcggttgctgaagcaagcgaattgtctaaaaaagacgctacaaaagcagttgattctgtttttgatacgattttagatgcacttaaaaacggtgataaaatccaactgatcggtttcggtaactttgaggtgcgcgagcgttctgcacgtaaaggacgtaacccgcaaacgggtgaagaaatcgaaatccctgcaagcaaggtacctgctttcaaaccaggtaaagctcttaaagacgctgttgcaggaaaataattgtgaatatagatcgtgtatgcatctgatacatacactttgtttcttcacagaaaagccccttgataaaggggcttttcatatttaagcagccccggtcaccgggcaggactttcgttttgcttttggcgcggcaaatgtgctagaatcgaaattaaatgtattcaatggtggaggacacagacaatgaaagaagttaataaagaacagattgaacaggcggttcgccagattttagaggcgattggagaagatccggaccgggaagggcttttagatacgccgaaacgcgtggcaaaaatgtacgcggaagtattctcgggattaaatgaagacccgaaagaacactttaaaaccgttttcggagaagaccatgaggagcttgttcttgtaaaagatatcgcgtttcattccatgtgtgaacatcaccttgttcctttttacggaaaagcgcatattgcctacattccgcgcggcggcaaagtgacgggcctgagtaaattggcgcgggcggtggaagccgtctcaaaacgcccgcagctgcaggagcgcattacttcaacgattgcagaaagcatcgtagagaccttagatccccacggcgtcatggttgtcgtcgaagctgagcatatgtgcatgacgatgaggggcgtaagaaagcctggcgcaaaaacagtgacttccgctgtaagaggtatttttaaagatgacgcagcggcgcgttccgaagtgttagaacatattaaacgtgcggattaataatgatagagggtgcagatatgaattcaaagcattcaagtgattttgtcgtcattaaagcggttgaggacggcgtgaacgtcatcggtttaacgagaggaacggatacgaaatttcaccattccgaaaaactggacaaaggcgaagtgattatcgctcagtttactgagcatacctctgccatcaaagtgagaggcaacgccctcatccagaccgcttacggagaaatgaacagcgaaaaaaaataagccggctgtttcccgcttttgccaaatgcccgcaaacggcgggagaatacagccaatttcttttttttatgctataatgatacctgcgtataataatgacgagtaaatctcatacatattagaataaatgtgaatttggggacaagggtgatatttttgcaagacatctacggaactttagcgaatctaaatacgaaattaaaacaaaagctgtctcatccttatttagcgaaacatatttccgcgcctaaaatcgatgaggataagcttcttctttttcacgctttgtttgaagaggcggacattaagaacaacgacagagaaaattacatagtaactgcgatgcttgtccaaagcgcccttgatacccacgatgaagtgacaacagccagagcgttaaagcgagacgaaaataaaaaccggcagctcaccgtgcttgccggcgactatttcagcggactgtattattcgcttttatctgaaatgaaggatatctatatgattcggacgctcgctacggcaattaaagaaatcaatgagcataaaatccgtctgtacgatcggtctgtcaatgacttgaatcaattgatcgaaagcatggcgattgtggaagcggccttgtttcacagagtgtcagaccactttaatcttccgcgctggaaagagctggcgagtgatttttttgtatataagcgactgatgaacggcaatgctatatttctcgatgtcatcggcaatattgtacagtcagggaaatcaaaggctgacataatggaagatagcttccgaaaggcaaagcaaagcattgaaacgctgctgccgctcaattcaccaatccaaaacctcatgctgaaccggcttaaagcgatcagccaggacaaaacatatcatcagaaagtggaagaagggtaatcaacatgcaggagtcaaaagaacagcgcgtacacggcgtgtttgaaaaaatctataaaaattatgaccaaatgaactctgttatcagttttcagcagcataaaaaatggcgcgataaaacgatgcagatcatgaatgtaaaagaaggcgcaaaagcgcttgatgtctgctgcggaacggctgactggacgattgccctcgcagaagcggccggaaaaagcggtgaaatcaaaggactggatttcagcaaaaatatgctgagcatcggcgagaaaaaagtgaaagagggcggttacagccaaattgaacttttgcacggaaatgcgatggagcttcctttcgctgatgattcttttgattttgtcaccatcggcttcgggctgcggaacgttcccgactatctgaccgtgctgaaagaaatgcggcgggtcgtcaaaccgggcgggcaggtcgtatgtctggaaacatcccagccggaaatgttcggattcagacaggcatattttctatattttaaatacatcatgcctttcttcggaaaaatgtttgcgaagagctataaagaatattcttggcttcaagaatcggcaagagaatttcccggtatgaaagaacttgcgcgtctgtttgaagaagcgggcctgacgaatgtcaaataccattcgtttaccggcggagtggccgctacgcatatcggttggaaatgatgaatatacagatgtttgggtgaatgatatgaaatttaaaatggcctattcttttttaaatgacgatattgatgtgatcgaaagggaacttgagcaaacggtgcggtcagactatcccttgctgagtgaagccgggctccatctgctccaggcgggaggcaagcggatccgccctgttttcgtattgctttccggcatgttcggcgactatgacattaataaaataaaatatgttgcggtgacgctggaaatgattcatatggcgtccctcgtgcatgacgacgtcattgatgacgccgagctgcggaggggaaaaccgaccatcaaagccaagtgggacaaccgtatcgccatgtataccggtgattatatgcttgcgggctcactggagatgatgacgagattggatgagccgaaagcccaccggatcctgtccaaaaccatcgtagaagtatgcctcggagaaattgaacagatcagagataaatacaatatggaacaaaacctcagaacctatttgcgccgcatcaaacggaaaacggctcttctcattgccgtcagctgccagctcggcgccatcgcttcgggagctgatgagaagattcacaaagcattatattggttcggctattacgtgggcatgtcctaccagattattgacgacattcttgatttcacttcaacggaagaggaactgggaaagccggtcggaggggatctgctgcaaggaaatgtcactctgcccgttttgtacgcgctccgtcagcctgaattgaaaaatcagctgaaattaattaacagtgaaacaacacaggagcagctcgcccccattattgaaaatattaaacgcacagacgcaattgaaaaatcaatggccgtcagtgacaggtacttaaaaaaagcgtttgaaaaactgaatacactgccgagaggacgggcgcgctcatcattggccgccatcgccaaatatatcggcaaacggaaattttaaattccttttacgaacaagatgtgaacattctccgccctggattgattaattgtcagaaagatgttacgatttcggtgtgcaacttgaaagcctatacataatgatggggtggagaatcttatggaaaaaacttttatcatggtaaaaccggacggcgtacagcgccagctgatcggagagattttatccagatttgagcgtaagggcttacaattggcaggagccaagctaatgcaagtttcagaacagatggctgaaaaccattatgctgaacataaagggaagccgtttttcggcgagcttgtggaattcattacatcaggacccgtatttgcaatggtatgggaaggggaaaatgtagtagagatcacaagacagctgatcggaaaaacgaacccgaaagatgcactgccgggcacgatccgcggtgactacggcatgtttgtcggcaaaaatatcattcacggttcagactccttagaaagcgctgagcgggaaattgacattttcttcaaacaggaagagcttgtaccgtatcaaaaattaatggccgactgggtgtactaagccttcagcctttctttttctcttgttatgaaaaggtttacatattttaaaaaagacagaggctgcgctgccctgtcttttcatttctcacaaatcagcctgcgggctgatttttttattgaaatcgtacaaattagaaagaaaacaggctatactaggacaaaagacagcgagattgggagagaagcaatggagccttacgaaatttttatcaccaagtggaaacaaataaccggcgttgatttatctttatacaaagaagcacagatgaaaagacggctgacgtccctttatgaaaaaaagggattcaaagattttcaggaatttgccgccgctttggagaaagacaagcttttattaaatgaaacattggacaggatgacgatcaatgtttctgaattttaccgaaattataaacggtgggaagttcttgaaacctcaattcttccgttaataaagcataacaaaccgttaaaaatatggagtgcggcctgttcaacgggggaggaaccctatactttggctatgattctcagtcagcaggcgggtttggccggatttgatatattggcgacagatattgatgaaaaggcgcttggcaaagccaagcggggcatctatcaggaacgctcgctgcaagaggtgccggcttccgtgaaaagccgttatttcaccaagcaggctgacaacagttatcaagtaaaacaagagattcaaaaaaacatccggtttaagcggcacaatctgctcgccgacagctatgaacaggattttgatctgatcgtctgccgcaacgtctttatttattttactgaaaaagcaaaagaagagctgtatgtaaaaatggcgggcagcctgaaaaagaacggaattctgtttgtcggaagcacagagcagattttcagcccggaaaaattcggccttgagagcactgatacatttttttatcaaaaaagatagaagacatttaatgaaaacttgtggtatagttttacttaaaagcgttaatgcgatgaagggagaagaaagaaatgagatacttaacagccggagaatcacacggcccgcagctgacgacaattatagaaggtgtgcctgcagggctttatataactgaagaagacattaattttgagcttgccagacgtcaaaaagggcacggccgtggacgccgcatgcagattgaaacggacagagcgaaaatcacaagcggcgtgcggcatgcccggacactcggttcacccatcgcgctcgttgtagagaataaagattggactcactggacaaaaatcatgggcgccgcaccgattacagaagaagaagaaagtgaaatgaaacgtcagatttcaagaccgagaccgggacacgcagatttgaacggggctattaagtataatcaccgcgatatgagaaatgtgttagaacgatcttccgcgcgtgagacaacggttcgcgtggctgccggagccgtcgctaaaaagattttagcggagcttggcattaaagtcgccggacacgtcctgcaaatcggcagcgtaaaagcagagaaaaccgattacacatccattgaggatctcaaacgggtaacggaagaatcaccggtcagatgctacgatgaagaagcaggccgtcaaatgatggcagccattgatgaagcgaaggcaaacggcgactcgatcggcggaattgttgaagtgatcgtcgaaggtatgccggtcggtgtcggaagctatgtccattatgaccgtaagcttgacagcaagctcgctgcagccgttctgtcgattaacgcgtttaaaggcgtagagttcggcatcggttttgaagcggccggcaaaaacggcagtgaagttcatgatgaaatcgtatgggatgaagagaaaggctatacacgcgccacaaacaggctcggaggattagaaggcggtatgacgacgggaatgccgattgtcgtccgcggcgtcatgaaaccgatccctactttgtataagccgctgaaaagcgtcgacattgaaacgaaagaaccgtttacagcgagcattgaacgttcagacagctgcgcggttccggcagcaagcgtagtggctgaagctgcagtggcctgggaaatcgcaaatgccgtcgtagaacaattcgggcttgaccagatcgaccgcattaaagaaaatgttgaaaacatgaaaaaactatcgagggaattctgatgaaagagcttgaggttcggacagcttcctccgcatatcccgtgtatatcggtgaaggcataaggaaacaggccgctgctcttttgtcttcactgaacaggccgctgacaaagatccttctcgtcatcgatgctgaagttgaccggctttacggcgatgagatgttccggcttttaaacgaaacatggcccgtgaaaaaagtaatcgttccaagcggagaagaagcgaagtctctaaaagagtatgaacggattcaaacggaagcgatcgctttccatatggaccgctcctcatgtatgatcgccttcggaggcggcgtgacgggtgatttggccggcttttgcgcagcgacttttatgcgaggaattgatttcattcaaatgccgacgacactgcttgcccatgacagcgcggtcggcggcaaggtggccgtcaaccataaactcggaaagaacttaatcggcgcgttttatcagccgaaagccgtgatttacgatacggagcttctgaaaaccctgccggaacaagagctgagatcgggcatggctgaagtgatcaaacacgcgtttatcgccgatcatgcttttttagaaaaacttctcacgtttgacacgttgcaaggactgacaagcgctgagctgaatgaaatgatttataaaggaatttcaatcaaatcggccgtcgtgcgtgaggacgaaaaggaagaggggataagagcttttctgaatttcggccatacgctcggccatgccgttgaggcggaatacggctacggccggattactcatggcgatgcggtcgccctcggcatgcagtttgccctttacgtgagtgaacaggttgcgggttgcaagatgaacaggaaagaactcacacaatggctgattgggctcggctacccgggaagtatcagacaagatattgaaacgccggttctctccgcccggatgatgaatgataaaaaaacgcgcggaggcatgacacagttcatcgtgttaaaggaattaggcgaagcgcgggactgcatgctttcaaaagatgagctcgaaaatttgctgaacaaatggcgaatggaggaaacagcatgatgatacgcggcattcgcggagcaacaacggtggaacaagacaccgaacaagaaattttagaaaaaacacagcagctgcttgaaaaaatcattgaacaaaatggatgcaaaccggaagacgttgtacagatcctgttatccgccacgcctgatatccattccgtatttccggcaaaagcggtccgccgcctttccgggtggcagtacgtcccggtgacgtgcatgcaggaaatggatgtcaccggcgctctgcaaaagtgtatccgtgtcctgatgacggttcagacggatacgcctcaggatgaaatcaagcatgtctatctagaaaaagccgttgtgttaaggccggatttatcattgacaaaaaatactgacatgtaatacgataaacaaagcttagaaatacacaagagtgtgtatagagctggtaagtaagatattgaacagttgagtttagaatagggtagcagagaatgagtttagctgagctgagataaacacgtttttattctgcccaaaagaagcctttcttttgggtttatttcttatacgcaagactcctctcactcttcatctcattctccttaccgtaaggaggagaatcatgaatttacaatcggatgtttctttatttttaaaggacagtctgacacaccgcaccattccaatcgcagagacttttacggtcgacacgatcacacccattcagatggttgaaaaactggacagaaacattacgtatcttttagaaagcaaggatgagtcgtcaagctggtcgagatactcttttatcggcctcgatccttttatcacgattaaagagagtcatcacacattcactgccgctgatccaaacgggcatacgctgtttgaagccggagaattaaaagccgtgcttgattggatgaatgaaagcttccgcattaaaacacccgagcttgatatcccgttttcgggaggggccgtcggttatctgagctatgacatgatccctttgattgagccttccgtgccgagccacgcgaaagaaacagatttcgaaaaatgcatgctgtttgtctgccggaaaatcatcgcgtacgaccacgaaacgaaacaagtgcatttcattcaatatgcggcgcttaacggccgggagacggaggaagaaaagcgggccgtttttaaagaaaattgcgcggagcttcgtaagcttatcggtattttgacagaaccgaaagatatgaaagagccgtttttttctaaagaaacatttgaaacgccaagttttgccgatgtgacatccaattatacgaaagaagagtttatggccggcgtcgataaactgaaagaatatataaaagccggagacatttttcaaggggtgctttcgcaaaagtttgacattccggtatccagacattcatttgagctgtacagggtgctccgcatcgtcaatccttcaccttatatgtactatatcaaactgcctgacagagacattgtcggaagttcgcctgaacgtctgatccgcgtggatgacagacacctggaaattcatccgattgccggaacgagaagaaggggcgccggaaaagaagaggacgatcgcctcaaaaaagagctgatgaatgacgaaaaagagaaagctgaacattatatgctcgtcgatcttgcgcgcaatgacatcggcagagttgcggagtacggttccgtagccgttccggaattcacaaaggtcgtttctttttcacatgtgatgcacatcatctctgttgtaaccggccgtttaaaacagggcgtccatccggttgatgcgctgatgtcggcattcccggcaggaacactctcgggcgctccgaaaatccgcgcgatgcagcttttaaatgaattagaaccgacttccagagaaacctacggcggatgtatcgcttatatcggatttgacgggtcaattgattcgtgtatcaccatccgcaccatgagtgtcaaaaacggtacggcgtcggtgcaggcgggcgcgggaatagtcgctgattccgtcccggaagccgaatatgaagagagctgtaacaaagcgggggcgcttttaaaaacgattcaaatcgcagaagacatcttttctggcggggaggagaagacggatgaacaaatttctgcaatcgtgcgttaatggccgcacgctgaaaaccggagaagccgaaaagctgatggagatgatgatgaacggggccatgtcgcagtctgagatcggggggattttatcggtattagcccaccggggtgaaacggcggaggagcttgccggatttgtaaaagtgatgcgggcgcgggcacagacatcaggtggcttggcggatgtcgttgatacgtgcggaacaggcggagacgggatttctacgtttaacatatccacggcagcggcgattacagcttctgccgccggagctaaagttgccaagcacggaaatcgctccgtttcgtctaaaagcggcagcgcggatgtgctggaaaagctgggggtttccattcaagccactccagaaagcgtcaaacgcagcattgaaatgaaacaaatggggtttttgtttgcgccgctgtttcattcgtcaatgaagcacgtcgccgccgcaagaaaagagcttggcttccgaaccgtatttaatctgctgggcccgctcagcaacccgctgcaggtgaagcggcaggtgatcggcgtctattcatttgataaagcgcgcctgatggcaagcgctttggaacaatttgatgtcagacacgtcatgcttgtgtcggcgcgtgacggattagatgaactgtccatcacagcaccgaccgatatcattgagctgaaaaacggtgaacgtctggaatattccgtttcacctgaacaattcggttttgcagaaggttcattgaaggatattcaagtgagttcatcggaagaaagcgcgcttctcattcagaatatttttgcaaatagagctccgtcatccgctctgcatattaccgccttaaatgcgggtgcggccatttatacggcaggtcttgcaaacgatctgaaagaaggaacgaaaacagccttagaagcgattcaaaacggagatgccaaaaggcagctcgaacgtctgaaacagaaagaggaagaaatgtatgcttgatcaaatcattctgcagaaaaaagaagaaatcaaatccatcgtgctgccggaaacctgtcaaattgaacggagatcctttaaagaagcgctcctgaacccgaaccgttttatcgggctgattgccgaagtgaaaaaagcttcgccgtctaaaggattgattaaagagcattttgttccggaaacgattgcggcggattatgaagcggctaaagccgacgccctttcggttctcacggatacccgtttttttcaggggagaaatcaatttctgacagatgttaaacaaaccgtgtctcttcccgtgctgagaaaagattttattattgattcccttcaggtggaggaatcgttcaggatcggcgccgatgccattttgctgatcggggaagcgctggaaccttcaaagcttcatgagctttatctggaagcccgcgggaagggcatggacgttctcgttgaagtccatgatgaaactgtgcttgaacggattttacaagtgtttcagccggacattctcggcataaacaaccgggacttaaaaacgttccgtacttctgtttcgcaaacggaaaaaatagcgcagcttgtgccggacggctgcctgctggtcagcgaaagcggcatcggttctttggctgacctgcaattcgtcaacaagcacggggcgcaggctgtattggtcggagaatccttaatgagagaggattcgcagcaaaaggcgatccgcggactgttcggagagtgacgatatgaaaaagcctgagttaaagtactgcggaatacgatcgaagcgtgattatgaacttgcggcagcttcagaagcggattatctgggatttatttttgccgcaagcaaacggagagtaacgccggatgaggtccggaaatggaaagagcaggtccggacagacaagaaacatgtcggagtatttgtaaatgaaacgatagaaaacatcgcgcaaatcgcatctgatctggcacttgacgtcatccagcttcacggtgatgaatcgcctgaggatgcccttcgcctccgtccgcttgtgcgctcggaaatatggaaagcgctccatcacggggaagggacgctccgtcagatggctcaatttacacctgctgtcgacggctatgtcattgattcttcagtgacaggaatgagaggcgggacgggaatcgcgttttcatgggcccgtgtccccttgtaccgaaagcaggctcaaaatgcaagcaagcgctgttttattgcgggcggtgttaatcctgaaacgattaccggcttactgagatcacgtccgtgcggtatagatcttgccagcggaattgaaaaaaacggacacaaggatcaaacactgatccggcttttagaagaaaggatgaaccactatgtatccatatccaaatgaaatcggaagatacggcgaattcggcggcaaatttgtccctgaaacattgatgcggccccttgaggaaatcgaaacggctttcacagaattaaaaaatgatcctgtttttcatgccgaatataaaaaactattgtttgattactccggaagaccgactgcattaacgttcgcagacagggtgtcagagtatttgggaggggcgaaaatctatctgaaaagagaagatttaaaccataccggctctcataaaattaacaacgcgttaggccagattctgcttgctaaaaagatgggcaaaacgaaaatcatcgccgaaaccggtgcgggacagcacggtgtggctgccgcgacagccgccgcaaaattcggttttaaatgtacggtttttatgggtgaagaagacgttgcgcgccagtcgctgaacgtattccggatgaaactgctcggcgcggaagtggtgccggtcacaagcggcaacggcacgctgaaagatgcgacgaatgaggcaatcaggtattgggtccagcattgtgaagatcatttctatcttatcggttctgtagtgggtccgcacccatatccgtatatcgttcgcgaatttcagaaaatcatcggcgaggaagcgaaagaacagctccgccgggttgaaggaacgctcccggacaaggttgttgcatgtgtcggcggcggaagcaatgcgatgggcatatttcaggcctttttagacgaagacattgagctgatcggcgccgaggcggccggaaaagggattgatacgccgctgcatgcggcaacgatcgcaaaagggacgctcggggtgattcacggatcaatgacctatttaatacaagatgaatacgggcagattatcgaaccgtattccatttcagcaggccttgattacccggggatcggccctgagcacgcctatctgcacaaaagcggccgtgtaacgtacgaaagcgtgacagacgatgaagcgattgccgcgttacgtctgctttctgaaacagaaggtattcttccggctattgaatctgcccacgccctggcaaaagcgtttgaaatggcaaaggacatggataaagacaaaatcattctcgtcagtttgtcgggaagaggagataaagatgttcatacgctgatgaatgttttggaaaacggggtggagacacatgtttaatctgcgagattctgaaaaattgtttatcccttttatcacagcgggcgatccgcttcctgacatttctgttgaactggcaatatcattacagaatgcaggcgcttctgcccttgaaatcggcgttccttacacagatccgcttgcggacggacccgtcatacaacgggcttcaaaacgggctctggaaaacggaatgaatatcgtaaaagccattgaacttggcggcaaaatgaaaaaaaacggcgttcatattccaattatcctctttacgtattataatcctgtgttacaattagaaaaagaatactttttcgctttactgcgggaaaacgacatagacggcctgcttgtacccgaccttccattagaggaaagcgcccttttgcaaatgacatgcaaaaaggagaacatcgcttatatctcgctggttgcgccgacaagtgaagaccgtttgaaaataattactgaacaggcctgcggctttgtgtattgtgtatcctctttaggagtgacgggcgtacgcagcgaattcgatccgtctgtatactctttcattcgtaaggtgaaagaattcagctctgttccggtggcggtcggttttggcatttcaaaccgcaaacaggttgacgggatgaatgaaatatctgacggtgtcgttgtcggcagcgcgcttgtcaaaaaagttgaagagcttaaaacaaagcttgtgaatcccggcacaagagctgatgcgcttcttgaatttgaagaatacgcgaagacgttcggacgactgtacagtgtaaaatgaggtgactggatttgcagattaaagaacagctgcggcagctgaaaccgtatcagccgggcaaaccaatagaagaagtgaaaatggaatacgggcttgaaaaagtagtaaaactcgcttctaacgaaaatccgttcggctgttcacaggccgcaaaagatgcgctgcatcaggagattgagcagcttgcgctgtatcccgacggttacagtgccgctttgagaacgcggctcagtgagcatctgcaggtcagtgaatcttcgatcattttcggcaacggctctgatgagctagtgcagattatctgccgttctttattaaatgatcaggcaaacacgattaccgccgccccgactttcccgcaatacagacacaatgcggtgattgaaggcgctgaggtgcgcgaggtgccgctccgcagtgacggcgctcatgatttggaccggatgctggaagcaattgacggcgagacgaaagtcatatgggtatgcaaccccaataatccgacggggacatatacttctgagcaagagttaattgcctttttaaacagagttcccgagcatatactcgttgtacttgatgaagcgtactacgagtatgttacggcggacgattaccctgaaagcattccgcttttaaagcaatatccgaatgtcatgatcctccgcaccttctctaaagcgtacggacttgctgcgctgcgcgtcggatacggcattgcggacgaagcgctgatccgccagattgaaccggcgagagagccgttcaatacgagcagaatcggtcaggcttcggcactggcagcgcttgacgaccacacatttattcaggaatgcgtcgagaaaaataaagcgggccttaagcagtattatgattttgcggaaactcacggattaacttgttatccttcacaaaccaactttgtgctcattgattttaaccgtccggcggatgaactgttccaagccctgttggaaaaaggatatatcgtccgttcaggacaggcgctcggatttccgacagcgttaaggattacggtcggtacgaaagagcagaatgaggaaattctcacaatcttagctgaaatattataagaggtgatcaagcatcacctctttgctctattaaaatagttgaaaaaggaaatgagtgaaatgaaggatactatattgcttgcggggatcgggctgatcggcggatcgatcgcattggccatcaaaaaggagcatccgcataaacggattatcggtgtggatatttcggaagaacagctcactgccgcgctgaagctcggaattattgacgagcgggccggctcattgacggaaggggcgcagcaagcgtctgttgtcattatcgccacgcctgtcgcccaaacgctgaaaatgctcgatatgctggccgcatcagacatcacccatgaactcctgattacggatgtgggcagcacgaaacagaaagtcgtcagctacgccgacaaagtgcttccggctcattatcaatttgtcggcggccatccgatggcggggtctcataaatccggggccgctgccgccaaagaatttttattcgaaaatgcgttttacattttaacacccggaaaatcaacttctaaagagtcagtaatgcatctgaaggaactcttgaaagcggcaaacgcccactttgtggagatgactcccgaggagcatgacggcgtaacgagcgtcatcagccatttccctcatatcgttgctgcaagcctcgtccatcaggctcatcattctgaagaaaattatccgtttttgaagcgtttcgcagccggcggttttcgggacatcaccagaatcgcctcaagcagtccggcgatgtggagagacatacttcttcataacaaagataaactgcttgaccgcttcaaagaatggaaacgggagattgacacgatcgaatcttatgtagaaaatgaagatgcggacagcctgttcggatattttaaaaaagcgaaagattatcgcgacggcctgccgctccgtcaaaaaggagcgatcccgtccttttatgacctttatgtcgatgttcccgatcatccgggggtcatttcggaaattacggcgatactggcagaagaaaaaatcagtatcaccaacatccgcattatcgaaacaagagaagatattaacggaattctcagaatcagtttccagactgatgatgaccggaagcgcgcggaaacctgcattcaatcccgcgccaaatatgacacattttacgctgactgaggtggaaaacattgaaaagagaaaaagtgacgtctttaaacggtgaaattcatattccgggggataaatccatctcccaccgttctgttatgttcggagcgcttgcggaaggaacgacaacggtaaaaaactttttgcccggagccgattgtctgagcaccattgcctgcttcagaaaaatgggtgtctccattgaacaaaacggaagtgatgtaacgatatacggaaagggcattgacgcactttgtgagcctgacagccttcttgatgtcggaaattccggcacgaccatccgcctgatgctcggcattttagccggacgcccatttcacagtacggtagcgggcgacgaaagcattgcaaagcgcccgatgaagagggtgacggagcctttaaaacagatgggagccgcgattgacggaagagcggacggagggtttacgcctttatccgtaagaggcggacaattgaaaggcattgattacgtctcccctgttgcaagcgcgcagatcaaatctgccgtgctgcttgccggattgcaggctgaagggacgacgaccgtcactgagcctcataaatcaagagaccatacggaacggatgctgaacgcttttggcgccgagcttgcggaaacggagacgagcgcttccgtaacgggcggtcagaaacttcggggggccgatattttcgtgcccggcgatatttcttcagcggcctttttcctcgcggcaggcgctgtcgttcccggaagccggattgtgctgaaaaacgtcggcctgaacccgacacgcacgggaatgattgatgtcttaaagcaaatgggggcttcacttgaagtgattccttcagaagcggacagtgcggagccttacggagacctggttattgaaacctcagctctgaaagcggcagaaatcggcggagaaatcattccccgtttaattgacgagatcccgattatcgcccttttggcaacgcaggctgaaggcacaactgtcattaaagacgctgcggagctgaaggtgaaggaaacgaaccggatcgacaccgtcgtatcagagctccggaaaatcggcgcagacattgaaccgactgaagacggcatgaaaatacacggcaaaaaaacgcttgcgggcggagccgatgtgtcaagccacggcgaccaccgcatcggcatgatgctcggtatcgcttcatgcctgacagaagagccgatcgacatccgtgatacagaggcgatccatgtctcatatccgacattctttgagcatttagatcaattagccaaaaaagcctgaagacgattcttcgggcttttttcttcatgtgtcataaaatcttgggctttgacatagcttgtcttaaacagaaaactaaaagaaagggggaatgcgttttcgttacagaaacagccggaacaaattgcgctgtttgcgtataaagatgccgtccccttttttgccgttttcctcttaaccattttctgataaactataatgccgggtgaagcatcttatttgcgggcaggccctgtctgaattatgataagaataacccgaataaaaacccttttcatttggttgatgaggtataggaaaagaaaggaccggtctgatttgaatacattgattcaagaagccataaaattagttgaagcaggtgaaaccgaaaagggactcaaagcgctttcaaaagctgaaacagagcttcatgacgaagacaaagccattgcagcccagctctactatgaatggggaaacgccgaaaaagcgttagcgctgatcagtgatctgcatgacctctatccgggtgagtctgagctgacgaatttttacgccgaattgttaatagatattgatgaagaagaaaaagctcttgaggtgctggagacgatttctccggaagacccgtcttacgcggaaagtctccttttaatggctgatctgtatcagatgcagggcttatttgaagtaagtgagcaaaagctgttacaggcgaaagcgatgttacaagatgaacctgttattgatttcgctctgggggaattatacttcactcagggatcatatgcaaaagccgttccttactatgaagagacggcaaaagaacggcacgaaatcggcggcgtaaacgttcatcagaggctggctgagtcattgagcgcggcgggtgaatttgaggaagcgatttcatggtatgaaaaagcggcggcagaacatacagaaccgaatacgattttcgggtacgggttcacagcctatcaggcgggaatggtcaaaacagccatcaagcagctgtctgatttaaaagggcttgatccttcctattcatcgctttatatgccgcttgcaaaaagctacgaggcagaaggcatgtatgaagatgcattaaaaaccgctaaagaaggtattacttacgatgaatacaataaagagctttttctctatgcggcgaaaatggcgttaaagctcggcagcgaagaggaaggcaaaaagcttcttcaggaagcgctggcgctcgatccgggttacgtggaagcgctccatacgcttttagccgtctatcataaagaagaaagctttgaagagattattgatctgattcaggaagtccgcggctacggagaagaagatccgaaatacaattggtatttggcgggggcctatacaggcctggagcaatacgctgaagcgaaaaaaagcttcgaagctgcgtatctccattatcaggatgatcgggatttcttatatgaatacgctcacttcttattggaagagggtctccagaaagaagcgctgccgcttttaaaacaagtgctttcaatggatggaacaaacgaagagcttgaagaaacaatcttacggatagaggatgaatttttaagataagcaggattttggaccatgcttgctgaatgtataagtgatgtcagattatacgatcgatagaggagggaattacatgcagacccctgtttctgtcaatgaaaaaaaggattttatccgttggtttttaaatcattatcagcttaaacgccgggagtgcgtctggattttaaattatttaatgagtcatgattcattaatggaaaaagtccattttgtagaacaagccgaattttgcccgagaggcattatcatgtctactcattgcgttgatgaggtgccgtttaggttttacaaagaaaatgtcatgactacggacgcggaaaaatcttttcacgacatccggttaaataaacagcaggatttatttatccagctgaatttccgttcggcctacagctcaccggaatatgccgctgttcttgaatcaaatccgcatctgccgaaagacctgtttgaaaataaacaggatcaggggatggctgaaaaaatattagaacatgccatttccactttccagcgggaaaagctgcttaaagatatcgacgaggcgctggaccgccacgacaaagaaacatttgaaaagctttcccgccaattgaatcagctcacataaatgacagccttgcagaatatgcaaggcttgttgcgtaaagaggaggaacgagacatgagatggagggccgctgatgccgatgcctatttacaatctgcggattacattgataccgctgtcattccgttaatttccataacgtcttcaggaggcttaaaagaggccgttgaacagggggaaagcacccaattgctttctgaagagcttgagcgccaattgaagggacgggtatatttattcccctcttatacatatgttgatatagaccaatcacaaatcgccctgcttcaaaaactcaaagaagaggtgatgaccaacttcaggcacgccttgttcctgacggcagacgaaaaatggaaggattctgaaatagggtctgatgtcatatacatacctgccgttccgtttgaacatatgaaagactctttaaagagaaaaattgcggatgacaagtgcggagaaattttgaacgttttgttacagaagtggaacaattcttaaaaactccaggcatcctgcaaaacacccgttttgcctctgttgaccttgctgaaagattcatatattatgagggtgtcaaatctcagaatcattttctattttagttaatttttggtcaatctttagggggggaagagatgggcggaaaacaagatatatcaagaagacaatttttaaactatgcgctcaccggcgtggggggatttatggccgccagtgcgcttatgcctatggtccgttttgcgctggatccggtattaaaaccgacgggagatcaaaaaatggtgcaggttgtcagtgtggatgagctgacgaaggagccgaagcggtttgactttaaaattcatcaagtcgacgcctggtacgaatcggaagaatccaggtcagcctgggtttacaagcatggggatgaaattatagcgctttctccgatctgcaagcatttgggctgcaccgtaaactggaacaatgatcctaaaaatccgaacaaattcttttgtccctgccattacgggctgtatgaaaaagacggcacgaacgttccgggcacgccgccgctcgcgcctcttgaccgttatgagcaaaaagtaaaggacggctttttgtatcttggaaaagcaaagcctaggggggaagggtgacatgctgaataaaatttatgactgggtggatgaacgtctcgatattacgccgatgtggcgggatatcgccgaccatgaagtgccggaacatgtaaatcccgctcaccatttctcggcttttgtctattgtttcggcggtttgacgttttttgtaaccgttatccaagtgctctccgggatgtttttaacgatgtattatgtgccggatataaaaaacgcgtgggaatctgtgtattatttgcagaatgaagtcgctttcgggcagattgtaaggggtatgcaccattggggcgcaagtttagtcatcgtgatgatgtttttacatacgctgcgggttttctttcagggagcttataaaaagcctcgggaattgaactggatcgtcggtgttctgatcttttttgtgatgctcggtctcggttttacagggtatttgcttccgtgggatatgaaggcgctgtttgcgacaaaggtaggtcttcagattgcggaggcgacgccattgatcggagcacaggtgaaaactcttcttgccggccaccacgatattgtcggcgcccaaacgctgacgagattttttgcgattcacgtattttttctccctgccgctttgtttgcgctcatgggcgcccactttgttatgatccgcaagcagggaatttcaggaccgctataatacaaatctgatataaaagggaggggatgacatgcaccgggggaaaggaatgaagtttgtaggagattcaaggataccggctgaaaaaaaaccgaatataccgaaagactattcagagtatcctggaaagacagaggcgttttggccgaactttctgctgaaagaatggatggtcggggccgttttcctcgtcgggtttctcgttttaacgattgtgcacgagccgcctttggaacgggtggcggatcctacggatacagggtatattccgctgccggattggtattttctatttttataccagcttttaaaatatgaatatgccgcagggagctacaccgttatcggagcgatgattataccggggcttgccttcgggtcgctgcttttggctccgtttctcgacagggggtctgaaagaaggccgtggaagcgtccggttgctgtcgggatgatgcttttggcgctttgcgctacggtctttttaacgtggcagtcagtcgcgacacatgactgggcaaaggcggaggagcaagggaaaattaaaaaagaagccgccattgatactgaatcagacggttataaggtatttaaagaacaaggctgtatttcctgtcacggggataatcttcaagggggaggcgccggtccgtccctggtcgataacgggctgagcccggaagaaattaaaaaaatcgccgtcaaagggaaagggcagatgccagccggtatttttaaagggaatgacaaacagcttgatcagctggcgaagttcatttctgaaacgacagcgaaataacgtattgtgaagtagacaacagcaggatatactttatgaaaagagctgaccggatgtcagctttttttgcatgatacatactttttacggactgagagttgatggtatgaggtggatttcttatcttttagggttgcgcggcatgcttctgcttgttcttgccgttaattttatcggtacggtgtacggctattattggtatgtgccgcagcttgcggacacgccgttccgatttctgatatttgtgcctgacagcccgacggcgacgtttttcttcctgtttgtgcttctggcatttctcatgagaagaaacgcgccgctgtttgaagcgctggctcttgtaacccttgtaaaatacgggctgtgggcggtcggaatgaatgtctttgtgctggtcaaaatggggcagatgccttgggaagggtacatgctgattgcttcacattttgccatggccgttcaaggcgttttatacagcccgtattttcggttccggttatggcatcttgccgttgccgctgtttggacgcttcataatgacgtcattgattatcttttcggcatgatgccccgctactcaatgctcaatgactatatgcaagagatcggctatgctacattctggctgagcatattttcactcggccttgcatactatttggtgatttctaaaagacggataaagcttgacttacactgatagaatcttggtctaaccttgtcccgctcctcatattctgtaaagagaaggagtgggagggacctctatgaaacgaaagctgacgatctgtcttttacttgctcttatgtgtttcatcacaactgccaaagctgaagatgagggcggtctcaaggaactgaacgacctttcggataccgttttccaaatgacgcggcattcgcagtatgatgaggctctgcaagtgcttggctactttaagaaaaaaatgacacacgtaaactcactgagcggcgccgaagtcaggcaggtgactctgggtttcaatgatttagtgcgcgtcctgaaacaggcagacgcctcagataccgaaaaaatccgggcagccgcccagttcaggttggtaatggatgcgatggaagaccactccgatccgctgtggggttcgcttgaaagaccgattatggcgacattcagcgccttaaaagaagatgtcagcggaaacggaagtggaaatttcaatgaaaagtggaatgaatttatatcattatatgatttaatttatcccagcctgacaatggatgtgtcggccggccagcttgatacggtggcgaaacatatcgaggtgattgagcaggaagggtttcagcagatgacaaaaggaacaaagcttgagcgtctgacgctcctgcagcaggatttaaagcgggtttttgacaaggtggagcgggatgacgctgacccttcgctgctctgggtcattctgacaacaggcggtatcattattactgcgctgacatatgtcggctaccgaaaatacagagcggaaaaaaagaaagagaaaaagcgtgagtatcctaagtctaaataaacacaaattgctgtaaaggagctaagtcagtgaaaaaactcatccagcaattggcttcaaaacacctcccgcagccgatcagaggcagaaaaggggcgactgacgaaggaccgcgaaacctcgcgcgtgacttccagaatcctgacatgctcgttccgccttcaacggatgcaggaacggttcaaaacttgaaattctcattttctgatacgcatatgaggcttgaagacggcggatggtccagagaggtgacggtcagggaactgccggtatccaaaaacatcgcggcggtgaacatgaggctgaaaccgggagctgtgcgggagcttcattggcataaagaagccgaatggggatatgtgattaacggaggagtacgtttaactgcggtcgatcaaaatgggcggaattttattgataacgtaagtgaaggggacctgtggtattttccttccggcattcctcattccattcaagggttagagcagggaagtgagtttttgctcgtctttgatgacggctctttctcagaaaacagcaccttttcagtaacggactggtttgcccacaccccgcgcagcgtgctggaggcgaacttcggtgttccgggttatgagctggcttacattcacaagaaagagcgttatatgttccagttggaagcgccgcccccaattgagcgggcagcagtctcttccccggaaggccccgttttggagccgttcagctacaagctttcccggcaggagcctcttgttaccagcgggggaagagtaaagattgtcgattcaaaaacgtttaaggtgtcaaaaacgattgctgcagctcttgtggaggtcgaacccggaggcatgagagaattgcattggcacccgaatacggacgagtggcagtattacctttcaggagaagcgaaaatgacggtgtttgcggcggagggaagagcacggacatttaactatcaagcgggtgacgtaggatatgttccttttgcaatgggacattatgttcagaataccggtgacaccgtgcttcgctttctggaaatcttcaaaagcgaccgtttcgaagacgtctccttaaaccaatggctggcactgacgccgcagcgcttcgtcgagcagacgctcaatgtcagtccggcattcgcccgccgattgaaaaagaaaaaatcaccggttgtcaaatggaaacacgaacagtaaaggcggcaaaagccgcctttttattatcatctgatcggatttttattttcatcaagcgtaaatccttcgccgagcacatcatggacgtcgcttactgcaacaaaggcatgcgggtcaacggaagtgatgacgcttttcaaaagcacaatttcgtttttcggaacgacgcagtaaagaacatccctgtcttcttttgtatatgatccctgtccttttaaaacggtgacgccgcgctccatctcttcaatgattttttgctggatcaaatcgtttttcgaagaaataatcgttgccccttttgcagcatagccgccttcctgtataaaatcaatcaacctcgcagcgacaaaaacggctacaagcgtgtacatcgcttccttgtaagaaagatacgtaaacaaagaaagcagaatgacacaggcgtcaaaggcaaacatcgtccggcccatcgggattccgaaaaatttgttgatcagccgagcgatgatatcgaccccgcccgtcgtgccgccgtatttaaaaataatgccgagacccgcgccgataaatacaccggcgaacaaggcggccagcgctaaatcatgcgacagcggcatatgaatttcgtagcgctgaaaaacactcagaaaaacggaaagagagacggtgccgatcagggtatagacaaacatcgtccggccgagcatacgccagccgatgaaaaagataggaatgtttaataccaggttggaaatagaagggctgatgtggaataacgcatataaaagcagcgtaatgccggtaaatccgccttccgccaaattgttctgcatattaaagtgaaccagtccgaatgaaaaaacagcggcgccgattaaaataaagcaaatgtttttgattctgatttctccaagcattgcatcaaaccccttttccttccataagattgcgtaaatattatagtggatacaaaagaaaacagcaaactgccgtttttaacatttgtcaaatgtacttgaattagctaacatggaagagatgacaggaggtattcgcacagtgagtgacaaaacgatgaaagacttacaagctgaggtcgatgaatatatcggccaattcaaagaaggctatttcagcccgcttgccatgatggcccgtctcacggaagaactgggcgaacttgcaagagaagtcaaccattattatggggaaaagccgaagaaaacgacggaaaatgagaaaagcatggaagaggaaatgggcgatgtgctgttcgttctgatctgcctcgccaactcccttgatatttcattggaggaagctcataaccgcgtcatgcataaatttaatacacgtgataaagaccgctggactagaaaagaagaaggaaagtaggagaaaccatgtcaaatgaaaccattaaagtcgtcattgccggaccgagaggcagaatgggccaggaggccgtaaaacttgccgtccgcacgcctcattttgagcttgtcggcgccattgaccatacatacgatcagcaaacattacgggaagtgatgtcagctgattcagacgctcttatttatacggatatccgcgcatgtttccaagaaacaaaaccggatgtgctgatcgatttgacaacgcctgaaatcggcaaaaaacatacgaaagccgctcttgaacacggcgtccgccccgttgtgggaacgaccggattttctgaagcggatttagaggagcttcaagccttgactgaagaaaaaggaatcggcgccatcatcgctccgaattttgcattgggcgcggtgctgatgatgaagttctcacaaatggccgccaactattttgaagatgtagaaatcattgagcttcatcatgatcaaaagctggatgccccgagcggaacggcgctgaaaacagcggaaatgatttcaagcgtccgtacagaaaagcagcagggccatcctgatgaaaaagaaattctgccgggcgcccgcggtgctgaattaaacggcatccgccttcacagcgtgcgtctgccgggccttatcgcccaccaggaagtcatgttcggcatggacggccaaacgctgaaactgcgccatgactcctataaccgggcttcctttatgtcaggagtgaagctgtcagtggagcaagtgatgaaaatcgaccagcttgtatacggactcgaaaatattatcgactgaatcggcaagggggagaacatcaaatgaaaattgctttgattgctcacgataaaaaaaagcaggatatggttcagtttacgaccgcatataaagatatattgagccatcatgagttatacgcgacgggtacgacaggcttaaaaatccaggaagcgaccggattgtccgttgaacgttttcaatccggcccgctcggcggagatcagcaaatcggcgcattgattgcggcaaacgccctggatctcgtcatttttctgcgcgatccgttaactgcgcagcctcacgaaccggatgtctccgcgctgatccggctgtgtgacgtatacgcgatcccgctcgccacaaatatgggaacagcggaaatcctcgtccggacgctggacggcggggcatttgatttccgcaatcttgtgcgcggaggagagccgaatgtctgaacacgttgatatcctggcgttcggcgcccatagtgatgatgtcgagatcggtatgggcggcacgatcgcaaaatttacggctcaaggaaaaaccgcggtgatatgcgatttgaccgaggccgaactatcatctaacggaacggtagggataagaaaagaagaagcggcagaggcggcacgaattctcggcgtaaaagagagaatccagcttacgcttcccgaccgcgggcttttgaaaagtgaggacggcatccgccggattgtcagtgtcatcagagcctgccggccgaaaaccgttttcatgccttatccgaaagaccgccatcctgaccacggcaatgcggcggctttggtcgaagaggcggtgttctcggcgggaattcataaatacagagatcatcaggaactgccggctcataaggctcagcgcgtatactattatatgatcaacgggtttcaccgtccggactttgtaatcgacataacggaaaccatcgatctgaaaaaagaaagcctgcacgcctatcaaagccagtttattcctacggcgcagtcagtgaacacaccgctgaccaacggttatatcgaaatggtggaagcgcgggaaagactgtatggcaaagaagccgggacggggtatgctgaaggcttcttttcaaaacagcttcccgttttgaatgatgatgtttttgggggcggacaatgagaccattaaaaatagggattacatgctacccgagtgtcggaggctcgggtattattgcgacggaactcggcaagctgcttgcggaaaaagggcaccaggttcatttcatcacatcaagcatcccgttcagattaaatacatatcatccgaatattcattttcatgaggtggaagtcaaccaatacgcggtatttaaacatccgccttatgaccttacgctggcgagcaaaatcgccgaggtggccgcgagggaaaatcttgatatcattcacgcgcattatgcgctgccgcatgcggtatgcgcttatctagccaaacagatgctcaagcgtgacatcgggatcgtgacgacgcttcacggtacggacatcaccgttttaggatatgatccgtcattaaaagatttaatccgttttgccatcgaagcgtccgacagagtgacggcggtatcaaccgcgcttgccggagaaacatatgacttaatcaagccggataaaaaaattgagaccatctacaactttattgatgaacgtgtttatcttaagaaaaatacagagagtataaaagagaaacatggtattttgccggatgaaaaggtcgtcatccatgtttcgaacttcagaaaagtaaaacgtgttaaagatgtcatccgcgttttccgtaatatcgcagccaacacaaaggcgaagctcctgcttgtcggtgacgggccggaaaagtgcgtcgcttggcagcttgtcgaaaaatacggactgcaggatcaagtgctgctcctcggaaatcaggacagggtggaagagctgtattccatcagcgatcttaagcttcttctgtctgaaaaagaaagtttcggactcgtcctccttgaggcgatggcctgcggcgtgccgtgcatcggaacaaatatcggcggcatcccggaagtgattaaagatcaagtaagcggttttctggtggaagtcggcgatattcaggcggcatctgaaaaagcgcttgccgttttagaagataaacagctcagcaaacgattgactgatcatgcgctgaaaatggtggagaccgccttttcttcgcaaagaatcgtcagtcagtatgaacggatttatgacgaattggcaggaccggagtgatcttatggaacaggaatttgtcaaagccctccccatccttcatcatctgatgaaggcgggccatcaggcgtactttgtcgggggagccgtcagagacagctatatgaaacgaaaaataggtgatgtggacatcgcaaccagcgcttcgccgaatgaggtggagcgcctctttaagcggactgtcgatgtaggaaaagagcacggcaccgtcatcgtcctgtgggaagatgaaacctatgaagtcaccacttttcgtgccgaatcagaatataaggactatcggcgcccggaagctgtgcggttcattacttctttatcagaagacttaaagcggagagacttaacgattaatgcgatggcgatgtctgccgaaggagagctgcttgattatttcggaggcgcacatgatatcggacaaaagctgatccgtacggtgggtaaccctgaagaccgttttcgggaagacgctctgcggatgatgagagccgtccgctttatgagtcagctcggctttctgttagaaaaagaaacaagagaggccgtcataaaagacagggagcttttggcacatgtatcagtagaacgaaagaccgtcgagtttgaaaagctgatgcagggcgctttctcacaagaagcgattcaaacgatggtgcagacaggtctgatacaagagctgcccggcctttccggttatgagcagcaaatgcttgaagcaagcggctttccgttttcttctttagatgcacgcgaagaacgctgggcagcgctgttattgtttctcggtctttgtccgaaaagtgccgaggcgtttttaaaacaatggaaactgccgggaaaggtcataaaaaaagcggtgcagatcataagcgtttatccggcgcagctggaagcagaagcgatgtaccgggcgggagaggcgctgttttcagccgttaaaatcgggatgctgaaacagcataagacgattgatgaacaaaagctgaaagaggttcagagcctgtatgagcagctgccgatcaaaagccttcgagacctcgacatttcaggcgctgatctgatggagctcagaaaccgccgcgcgggtaaatgggtggccgaagaacttcgccggattgaagaagcggtattggcagggaagcttcctaaccgaaaacatgacataaaggagtggctcgcatcatgggatcaacattaagaacccgattaattgatttattttctgaggcgggtgacggctttatctccgggcagaaaataagtgacgcgctcggctgctcgagaaccgccgtttggaaacatatagaggagctccgcaaagagggctatgaggttgaggcggtcagacgaaaagggtacaggctcattaaaaaaccggggaaactcagtgaatccgaaatccgtttcgggctgaaaacagaggttttgggcaaacagcttcattaccgggacgtcctgccgtccacccaaaaaaccgctcatgaacttgccaatgacggcgcgccggaagggaccctcgtagtcgccgataaacaaacggcaggcagaggaagaatggccagagtatggcattcacaggagggaaacgggatttggatgagcctcattctgagacccgacgttcctttgcaaaaaacgccgcagctcaccctgttatccgccgttgcggtcgtacaggccatcgaggcttttacaggcgtacaggccgccattaaatggccgaatgatttaatgattcacggcaaaaaagccgtcgggattttaactgagctgcaggcggaagaggaccgtgtccgttcggttattctcgggatcggcatcaacgtgaaccagcaggaaaccgattttcccggcgagcttcaggacattgcgacgagcctgagcatggaagccggtgaaaaaattgacagagcgggtctgatacaagagattctgctgacttttgaaaaacgctatcaggattacttgaaccacggctttacaccgatcaagctgctatgggaaagctatgcggtcggactggggaacgagctcagagcgagaacgctgcaaggaacgttttacgggaaatcgctcggcattgatgatgagggagttcttcttttggaaacgagagacggtataaagaagatctattctgccgatattgagctcaattaatcttagttggtacaagcctcgtgaatttggtatacttcctatgggcagtatcataatgaactgcacctgatcagcagaacagagattacgaaaagtctgccttgatccaaaaaaggactgggacagagggatgacattcgccgaacgttaaacaagtgggaatccttcttattttacagaaggcttttttgcttgcgaagaattggcggctcatctcctcaccgtttagaggaggagaaacagaatgaaaacaaaactggatttcatgaaaatgaaggaaaacggagagccgatcgtgatgctgaccgcttacgattatccgcaggcaaagcttgcggaacaggcgggagtcgacatgattttagtcggggattcgctcggaatggtcgtgctcggactcgattcaaccgtcggcgtaacggtcagggacatgattcaccatacaaaagcggtaaaacgcggtgcgaaaaatacgtttatcgtaactgacatgccgtttatgtcttaccacctttcaaaagaggatacattgaaaaacgccgcggccattattcaggaaagcggcgcggacgcgttaaagctggaaggcggagacggcgttttcgaatccatccgcgcgctgactctcggcggaattcccgtcgtcagccatttaggcctcacaccgcagtctgtcggcgtattaggcggatataaagtgcagggaaaagatgagcaaagcgcgaaaaagctcattgaagacagcatcaaatgcgagcaggcgggagcgatgatgctcgtgcttgaatgtgtgcctgctgaactgactgctaaaataatagaagaagtatccattcccgtcatcggaatcggagccggttcaaaagcggacggccaagtccttgtctatcatgatgtcgtcggccacggcgtggacagaacaccgaagttcgtgaagcaatacgccaacatcgacggcgcgattgagtcggccctcagcgattatgtccgtgatgtgaaagaacgggttttcccggaagaaaagcattcctttcagataaaccaaactgtgctgcaaggcttatacggaggaaagtaagcgatgaaacaactgacagaaactcaacagctgaaagaattaattgcacaataccgctcagaaggccggacgatcggattcgtcccgacaatgggttttcttcatgaaggacacctgaccctggttgaaaaagcaaacaaagaaaacgatattgtcgtgatgagcatctttgtcaatccgactcaattcggaccgggcgaggattacgaagcatatccgcgagatttaaagcgcgatgcccggcttgcagaacaggcgggagcagatgttttgtttacgccgtctccgagtgacatgtataagggcgagcaaaatgttgccgtgcaagtgaaaaggagaactgacgtgttgtgcggcgcctcccgcgtcggccattttgacggagtggccactgtgctgacgaagtttttcaatctcgttaaaccgacccgcgcctacttcggcctgaaagatgcccagcaggcagcggttgtggacggattgattgaggatttctttatggatatcgaattggttgcagtggacacggtcagagaagaagacggacttgccaaaagctctcgcaacgtctatctgactgagcaggaacgcaaagaagcgccgatgatctataaagcattgcagcaaggtgccgaactggtcagagacggtgaaagaaatccggaaaccgttataaaaaccgtcaccgatatcatcgaaaacacaagcggcgtcattgattatgccgaactgtacgcttatccggagctgactccgcttaaaacattaaacggcaaggtcattctggcctgcgccgtccaattttctaaagccagactgattgataatatcattattgatattgatgaatgggagagatcataatatgtaccgcactatgatggccggaaaactgcaccgcgctaccgtgacggaagccaatttaaactatgtcggcagcatcacgattgatgaagatcttttagatgccgtcggaatgctcgctaatgaaaaagttcagattgtgaataataacaacggagcgagacttgaaacgtatattattcccggtaagcgggggagcggcgtcatctgtttaaacggagctgccgcccgtctcgtccaagaaggagataaagtcattattatttcttatcaaatgatgtctgatcaggaagcaaaaagccatcagccgaaggtggccgttctggatgatcagaataaaatcgagcagatgctgggccaggagccggcacacacgattttgtaaaagagcccccttcatgggggttttcttttaagatttaggggcaaaagctgtttttccgctccatttctcaacaaaacgtgttacacttttctcgtatgcaagaattgaggtgtccattttaatgaacaaacaacggttcgttgtcatagatgtcgaaacaacaggaaattcgccgaaaaagggcgataaaatcattcaaatcgcagcggttgtcattgaaaatggacaaataactgagcggttttcaaaatatatcaatccgaatcaggccatcccgccgtttattgaacagctgaccggaatttcgtccggaatggttgaaaatgaactgccgtttgaagcggtcgcagaggagatttttcatctgcttgacggcgcgtattttgttgcccacaatattcatttcgacctcggatttgtccggcatgaactgagcgaagcgggctatgagctgccggattgtgaagtgcttgatacggttgagctttcgcgtattgttttcccggggtttgaaggatataagctcggtgagttgtgcgcggagctgaatattgttcatgaccgccctcaccgcgcagacagcgatgcggaggttacgggcctggtctttttagacattttacataaactgaaacatctgcctttaccgacgttaaagcagcttagaaggctttcacagcattttatcagcgatttgacgctgcttttggattcttttatacatgaaagcaggccggcggaagaaaagagctgcattccatacgcctctttttcaattaaagagcccgatcacattccggtttcccgtccggtgaatgcagccattgaccttgaaaagtggaacgaagaaaaagaacagatcttgtccggcatcatcccccgctatgaaaagcggaaaggacagcttacgatgatggatgaagtgcttggcgccttccgcaatcgggagcatgcgctgattgaagcggcgcccggcatcggaaaaacgatcggttatctcgttccggctgttttatttgccaaagcggaacaaactcccgtcattatcagcacgtactctactcttttgcagcagcagatcatgtctaaagatcttccgcttttggagcgtatgtttccttggccggtcaaagctgctattttaaaagggaaatcacattatctgtgcctgccgaagtttgaacatattctgcatgaggaagatgacaactatgatgcggttttgacgaaagcgcagcttctcgtctggctgacggagactgaaacgggcgacgccgctgagctgaatcttccatcaggcggcagattgctgtgggagcgcatggcttacgatgagaattcttttatgaaaaaagggaaggactcggctgccgggttttatgaacgggctaaagaaaaagcgcaggccgcagatctgattatcacaaaccatgctttgctgttttcagatcaaagcagtgaaacgaaaaaactgcctgcaagcggaacagtcatcattgatgaagcgcatcatttcgaacgcgccgccagcgagcacctggggaagagagcttcatacatcggactgcacacaaagctcagccgaatcgggaccttaaaggaacacggactgttaaagcggatgagaaaactgttttatacgtatgaactgccggcggaaagtttttttgacgccgatgagtggatgaagcatattcaatcggaaagcgacgcatttttcagttcagtgcattcttttgtcaaacgaagaaaacctaaagacgatctgaaccgtctcgtctatagtctcaatcataaaagccaggataaagggtttcacatgataacggacggagcggagcggctttgtgcgatgctggatcagctgcttgacatgttttccgtacaggagaaactgttacaccaaaagcttgatcagatgaaaagcggagcggcttttttagcgggcgaatatgtaaagtgtatcagggggctgaaagaatatcgcgatacgttcagcaggctgctgtttgaaaatgatgagaaagaagccgtttgggttgaaattgatgcgaagggcgcaaaaaatgccgtcagcatctatgcgcagcctttggagcccggtgaaatgctggcagaccagtttttcgcccgcaaaaaaagcgttgtgctcacatcagcgaccttaatggtggagcagtcttttcaatttatgattgaaaggctcggacttgcggatttttatccgcgcaccaaaagcatcccgtctcctttttcttacgatgatcagatgaacgtcatcattccgaaagagatgaaatccgttaaatatgacggggagcgggaagtcattgagcatattgccaagtatgcagaaatcatgtcaaagggaaaacagccgaagatccttgtcctgtttacgtctcatgatatgctgaaaaaagtgtatcaggaactgaaactcagtatggagatctcaggcattcagcttctcgcccaaggtatttcaggcgggagtcccggtaaattaatgaaaacctttaaaacggcaagccgggcgattttgctcgggacgaatcatttctgggaaggcgttgattttccgggggatgaattgtcaaccgtcatgatcgcaagacttcctttcagggcgcctgataatccgcttcacgccgcaaaatgcgaatttgccaagaagcaggggaaaaatccgtttcagacgatttccctgcctgaggccgtgttaacgttcagacaggggatcgggcgcctgctccgtacggcgggagacaagggaacgatcgttcttttagatcagcgtgtaaagacggcgggatacggacggctgtttcttgaagcgctcccgacttcatccctattggagctgacggatgccgaactcggggcttatgtcagccaaacggaataaaagccgcttaaacgcggctttcgtggtgtgggatgaggaattgtttttatagtaaaagcgggttcatgccgccttgtgattttattatgccgcgggcgcatcccgttatgactaacaaaatttgttcgaccgatggagggtataaaaatggaaagcaaaattgaaattctgtcaacgattaatgtggagcattcagatgatttatataaaatcgtcgatacattaaaccggactttgaaacgggacaacttgatgttcggccttgcgctcgacgaagaaaatcaaaatgaagcggtcttcaccatttatcgcacataggtgaaaaagatgagaaaaaaagcattaatatttacagccgtatttggtattatttttttagcagttcttttattttcggccagcatttttaaatctgcaatggctcaaaaagaagaaggccacgaaacagctgccgcagccgctaaagaaaaaacgaatctgacagacgctgagaaagtggagacctttgtcggcaaacagaaatattatgttgttaccggaacggataaacatggaaaagatatgtatgtatgggttccggccgacaaaaaagcaaaaattctctcaaaaaaagccagtgacggcatttcaagcggcaaggctgccaagatcgttcgggacgaagggcttgtttccaagctgaatggcgttcacccggcgagagaaaacaatgttccgttatgggaagtgacctatatcaacaaaagcgggcagtatagctttagctatgtggactttacaagcggcaagattctcaaaaacatcacaccgtgagacgtattagggggagttcaagttgaaattggcaaaaagagtatccgcattaacaccgtctgcaacacttgcaattaccgcaaaagcgaaagagctgaaagcggaaggccatgatgtcatcggcctcggagcaggagaaccggattttaatacgcctcagcacattatagatgccgcggtgcgttccatgaatgaaggccacacaaaatatacgccttcaggcggtctgccggccttgaaagacagtatcgcaaaaaaattcaaaaacgatcaggggattgaatataagccgtcagaaatcattgtctgcaccggagcgaaacacgctctgtatacattatttcaggtcattctcgatgaaggggatgaagtgattataccgactccttactgggtcagctatcctgagcaggtgaaactggcaggggggcgtcccgtctatgcagaagggctggaatccaatcagtttaaaatttcaccggagcagctgaagcaggctatcaccgagaaaacaaaagcgctcattatcaattcaccgagcaacccgacaggtgttatgtatacgaaagaagagctttcggaactcggaaaagtgtgtctggagcatggcattctgatcgtttctgacgagatttatgagaagcttacatacggaggaaaaaaacacgtctcaatcgcacagctttcagatgaattgaaagagcagacgatcatcattaacggcgtttcgaaatctcacagcatgacgggctggaggatcggctatgcggcgggttcggagacgattattaaagcgatgacgagccttgcaagccacagcacctcaaatccgacgtccatcgctcaatacggcgccattgcggcctataacgggccggctgagccgctggaagagatgagacaggcatttgagcacagactgaataccatttacgctcagatcagtgagattcccggattcacctgtgtcaaacctgaaggagcgttttacttgttccctaacgccaaagcggccgcagaaaactgcggattcaaagatgtcgatgaatacgtcaaggcgcttctggaagaagaaaaagtcgccatcgtgccgggctcgggtttcggttcaccggacaacgtccgcttatcttacgcaacgtcactcgatcttttagaagaagcggtcaagagaatccgccgctttacggaaaaacacagctgattctgaaaaagcggcttttaaagccgcttttcacttgcattgaccccgttagagtagaacgggtataataaagtgatgaaaaaagagattcaggcagattcctgaatgtctttcttgttctggagggaaagagtttgaaaacaacaatcaaccaagtgtataaacacacaggcgaggaagtaacgattggagcttgggtcgctaataaacgctcaagcggtaaaatcgcatttttacagctgagagacggtaccggcttcattcagggagttgtcgtcaaagctgaagtagaagaagacatcttccaaatcgcgaaatcagtgacgcaggaaacgtcactttatgtaaaaggaattgtgaaagaggacgagcgttcaccgcttggctatgagcttgctgttacatccattgaagtcattcacgaagcgactgattatccgattacgcctaaagagcacggtacggaattcttaatggatcacagacatttatggctccgttcgaaacgccagcacgcgattatgaaaatccgtaacgaaatcatccgtgcgacttatgaatttttcaacaaagaaggcttcgtgaaagttgatccgccgattttgacgggaagcgctcccgaaggcacgactgagctgttcgcgacgaaatattttgatgaagacgccttcttgtctcaaagcggccagctgtatatggaagcagctgcaatggcgctcggaaaagtattctctttcggaccgacgttcagagcggaaaaatcgaaaacgaaacgccatctcatcgaattctggatgattgagcctgaaatggcatttgttgaatttgaagaaaaccttgaagttcaggagaattatgttgcatacatcgtacaaagtgtgctggaacattgtaagatcgagctgaacacattaggaagagacacatcgaagcttgaacaaatcaaagcgccattcccgcgcattacgtacgataaagcgattgaattcctgaaagaaaaaggctttgacgatattgagtggggagatgacttcggtgcgccgcatgaaacagcgattgcagaaagctatgacaaaccggtgtttatcactcattacccgacgtcattaaaaccgttttatatgcagcctgccaaagatcgtgacgatgtcgtgttatgtgccgacttaatcgctccggaaggctacggggaaatcatcggcggttcagaacgcgttcatgatatggatttattggaagaaagattaaaagaacacggtctggattcagatgcttacaaatggtatgctgaactcagacaatacggttcagttccgcactccggcttcggcctcggacttgagcggacagtggcttggatcagcggagcgcctcacgtgcgtgaaacgattccgttcccgagacttctgaaccgtctgtatccgtaatagttatgaaaaacgaagtctcctgcaagggagactttttctaagtaaaggggaaagctcccggagataaccttttacagtaagaggtgtaaggatgaaaaaacagcaatttatagatatgcaggaactcggcatttcaagcattcccaacctgctgctgacacattaccggcagctcgggctgaatgaaaccgaattgatcctgcttttgaagattaaaatgcatttggaaaagggctcttattttccgacgccgtttgaacttcaatcaggcatgtccatctctgctgaagagtgtacaagctgcctgagaatgtttattcaaaaaggttttctgtttattgaagaatgtgaagaccataacggcataaagtttgaaaaatattctctgcagccgttatgggcgaagctgtatgattacatgcagcattctcaaaatgaaacgcaggaaagaacgtcagaaagagaacaaaaaagcctgtataccatctttgaagaagagttcggaagaccgctgtcgccgcttgaatgcgagacgctggccatatggcaggatcaggatcagcatgatgcgattctgattaaacacgccttaaaagaagccgttttatcggggaaactcagttttcgctatattgaccggattttatttgaatggaaaaagaacggcttcaaaacggttgagcaggcgaaggcgcacagccaaaaattccggcgtgttcaaacaaaacagaatgatccgcaaaaagagtatacgaggcaggtgcctttttacaattggctggaacaataacatgagaaggggagaaacgtgctaaatttaaagcagattgaatattgtcttgaaaaaatcggcgatatgtttccgcacgcagaatgtgaacttgtccattcaaatcctttcgaattggttgtggcagtcgcattatccgcgcaatgtacggacgctctcgtcaacagagtgacaaaaacgctatttcaaaaatataaacggcctgaagattatcttgccgtatcgctggaagaactccagcaggatattaaatcaatcggtctgtaccgtaataaagccaaaaatattcaaaagctgagcaaaatgatcattgaagagtacggcggagaagtgccgaaagaccgggatgagcttgtgaagctgccgggtgtcggacggaaaacggcaaatgtggtcgtgtctgttgctttcggcgtacctgcgatcgcagtagacactcatgtggagcgggtctctaaacggctcggcatctgccgctggaaggactctgttttggaagtagagaaaacattaatgaaaaaagtgccgaaagaggattggtctgttacgcatcacagattaatatttttcggccggtatcactgtaaagcgcaatctccccgctgtgcggaatgtcctttgcttccgctatgcagagaagggcagaagcgtgacaaaaaagggctggtgaaacggtgacggcgattgacattctggcaggctatgaaacatacctgcgcagccttacggacttggaaagcctcgagatcaaagcggcgctgcgccgccatccgctgtatatggatttcagcggccagccaacagtgcagccatggagggaaaggggcgaatatgtcccgtttctttttcagatttggaatgaaacgaaagaaacgctgcttcccgtttttcaaacaagaaaatcgaggtgtgatcaaaatgacatgctgaagggaatagcctgtctgattgccgcttttcattggacggcaggggagcgggtcacatcactcgactggactgtgcttgaaacaaagcattttcccgcggaaccgatcaattgggcggagcgaatggcgtttattttaacaaaaccgactcaatatcactcgtttattcagctggatgaattgatgacggagatgaagaaacaatatcataaatatgaagccatgaacaaatgttaaaaacctccttttcccataaggaggtttttttgtacgaaaaaaatccttcacctgtttggggtgaaggatttcgtccgctaatgagcgggatttgactggatggttgacgaattggactgcccgttgatagttgaagatgagtcttggtttttatccgtttgaccgctgtcaggtttatttgagccgtctgaaccggaatcggaatcattatcagagccgttatcttgctgtccgttgttatcggtcccgttgccgggctgattctgattgttgttatctgtttgatccttatcggattgatcctgatttttatccgggtcatcagttggtgtttgatccgatccgtcagacgtatctgtctgatcgtcatctttgtttgaatcatcggtttgcgtcttgtccttatctttatcttcatcagtcttctgttcatcgtcagtcgctttatctttatccgcatcgtcttcttcatctttcgggactttgaaagatgctgatgccgtatcgctttttccgtcatcgttttccgctgtcacctggaagctgtatgtggagcctggcgtgacatttgagacgacggcttcttttgccgaactgttttgaatgtcactgtagcttccgccgtcaacggattgtttgacattgaatgttgcatcaccgtcataattccagcttaaggttaatgattttttatctttgtcgtatttcacttgcaatcctgtcggtttatcggctttttctttcgtgtacgttttagaaacggcagttggctgcgtccctttcacgaagtactccgtcacttttttatcatccggcgtgttcggtccggctaaagcggcaggattcgagcctttctcaactgtttcttttacgacgctgtcaggctgcttgaagcttcctttaccgtcatcaacgtatgagatcagcttttggaaaatccgttttgcgacttgctggtctgcagaagacagtgatttcttgcctgctttgttgccagactcaactccggtccaaaccgccgcagtatattgaggggtgtatccgacaaaccaggaatccggaactccgcctggagcaatgttatatttttgaatatcacctttagtaaagtttgtcgtacccgttttaccggcgacttccacgttcggtacttgagccagtctgcctgttcctgactgcacgactgttttgagcatatcggtaatcatgaatgccgtgtaatcgctcatagcacttttcggtttcggtgttaaatcaagcttagtgccgtcattaaattcaatcgatgtgaccgcatgcggttcattgtacgttccgttatttccgaaagcgctgtaggcgcctgccatggtcatagtagatacaccgcgattttcatccccaaaaccgccgatagaatagggctcatatacttgatctttgtttaaacctaatcccaggtcgtttgcaaagtccacggcattatcctttccaactgcttggaatgcttttaaagcagggatattacgtgagtctgcgagggcctctcgcattgatatctggcctctgtatctattgtcataatcatggatcggtgtgccgttagagtacgtatatgcagaatcgtcaatctgctcatacgtcgaccattttttattttcaatgaccgggccgtaatcaagaatcggttttatggttgaaccgggctgggttttaccttgtgttgcataattgaatccgcctgcagttctgttccgtcctgctccgatggcgcggatttctccgtttgtcgtatcaaggagcgtgacgccgccctgcatgccttcggtaaatccggctgtatcgccgttcatcaattgatcaagataatcttgtgctttcgtatcaagagtcgtataaattttcagtccgtcagttgaaatatcaacgtctttcttttcttttgtctcaatttctttcataacttcttcgacaaaagcgctgtatttatttgtgtcctttttatcgtattccttttggctgacgacgccttcatctttcatggacactttcttcgctttttggtattcagagtttgaaatgaatccttgtttttccattaagctgagaacgatgtttcgtcgtttttcggaagccttcgggtttttaaccgggttatatccggtcgggctttgcggcattccggcaagcgttgccgcctgttcaaccgtaagcttgctcaagtcttttacgccgaagaattcttcagccgcttttccgacgccgtaggcgcgcggtgagaaataaattctgtttaaatacatttctaagatttcatctttagaataatggcgctccagctgcagggaaagccacacttcctgtgctttccgtttaatcgttttctgatgggtcaaaagcgagtttttcacaacctgctgggtgattgtgcttcctccctctgaaccgaacccatccgtaaagttggcgaccaaagcgcctccgatacgaatcgggtctataccgtggtgcttataaaaacgggcgtcttcagttgcgataaatgcttctttcacaacatcgggtatatccttaatcgggacgtaggttcgtttttcaccgcccacttccgcgatttcttttccgtttttatcgtaaatcgttgaagagtaaggcgttttcagcttggcttcgtccaaagacggcgcgccggaaaccaaaacggcaaatgccgccgctccgccgactatgccaaggacaaacagaataaccaaggacagcacaatctttttgaataaaccgcctttacgctgtttcttgccttttttcggtgaagagggcttagtgcttttcgtctgccttgccttacggcgttcttcacggctcgtaaattgatctgacataacatctcaacctttcgtttatcaacctttcgctcagtctactgttcctgcgaaaaataaagctgttcaataatactaatataatcaattctcggtgagtatccaagggaaatcggaaaggaagcatcttctaattcgtctttgcgaattgattttctgccgttcttctcctttctctcccaaaagacaaacagcttgtcggcttcgaggaaataaacctttccgaaagcggatataataacaaaacaaatgccgtcttgcctgaccacctgcttcatatgctcaatctgatgatcatgaaaattctgcaggggaaatgccgttttgttttttgtttcttttgcctcgaaatcgatgtagcgtcctttataaatgccgttgtagtcagttgttgaagactgtttaaaataagcttccttaatgactgcggcgcttcttttcggatagtggacgtttacaatctggacgggtgtcggctttttgtgaatgacagcaatttggttagccagataatacttattcgtttcattcaggtcgtcttcgagggtcatgccgcgattactgtatgaatgagaccgtttctggctgttttgggatgaaaccgttttgttcggctgaaaagtttttccattcgggtaccgaatcactttttccatcctccttatcaaactaatagtgacggaagtgaatgaacgtgcataaacgacagaccgtaaccgccattcttcgcctgatcgaaaaagagacgaaaataaaaaatgccgataatatttcccggacgaatgcctataaagcatattatgaccgccatcctgagatcaagtggccgcttttggcatcctttgtgtcccgcaatgcgggctggtcgatgactgatttaagaggcgtcctttatcaggagggccttgacagcagtcagaaaaactggtttttcctttcgtatgaaagggcgaattggctgattttttctgatgcctatcctcagcttctggtctaccagtggtcaaaacaaatcggcgaacctcttttccgtcatcttccttatttccgcgtctcggcttttatgcaggaagaatggttccgcttttggcgtgacggagatacggaacggctcatgtatgctcttattataaatgaacaaaacactatccaagcacctattatacaaaatccttcgtttaaaaagaatgtttttggcacgattcctttttatttaagtgattggtttcactttaatacggtgatattcccttcatttgacggacatttatacggaatttccgtcaaacggttttcaaaaaccgaagagagaattacgctcggaaaacagctggcccgccttctgttcagccctgatcttcacgcttctttttaccgttttcttgataccgttcctcataccggttcacgctttgatatggagaaaatgatcggcatcaaaaaaagaacatcaccgatgcttaggacaacctatcccattgttgcccacccattagacggcgaaagggcggattggtttcaaaaaaggttaagaaaaggggctttcttacaggagaaaatgccgaaacagcttgaactgacggactggtacttccagaaaagacgggagctccatgcgctcttcgcggttaaagagtggctgaagaaatgaaaaagcccgaaaccgttcgctggggtttcgggctgctgatgtgttacgtggaagggcggtttgggccgcctaattttttatcaagcgtatcagtcgtttttgcttcggttttttgctgtttacctgcatttttcggtctcgttttcatacggcacctcctcaactgtatcgtttgcattaacgtgccggttcatacaaagtttgcggcacttttttgtcgaaaggcacgccttttaggataatctctgtttgtttgccgaactgcttctagttttgtcatgtgcagaggagagcggtatgaaaacgagaattatatttgaaagagatgcaagtgataaaagggaggaacatgaatgtctgtttacacgagcaaggctgatattctccgtctgctttctgatatcgaaatccggatttctgctgctgaaaaaacgcttacccaagcagtcagatgctgtcaggcggaagctgaagaaatcagacaggagaaactttcccgtcttgaggaagaggcgcgggagcttcatgtttgtattgatgacctgtttttgactgaccggcgtaaaaaggatttgccgcgagtctgccggataagctgattttgtgcaaaaactttggtaccatatgtactgaggtgagtccgtttgcagacacagtcgttattggagctgacagaacaaatgatagaggcggttctggaagccgaaaaaaggtatcaggatggaaaagagtcaggccgttcatatgatttttttgagacgattaaacccgatgttgaaaaaagagaccggctttgcgcgctttggacagaagcagcgcttgcgtttattcaggaaaaccgtccgaaatacgttcatcatgcacaaattcaggccgttacagaaaatttcggggagctgatgctccaatcatatgttcatcatattcataaaaaaagatacagggatttaactgaatctgttttatatacgcttcgtatattaagggatgaaattgaaaaagaaggcagctgaaaacggctgccttcttttatataaaggggtcgggtatgttattcatacgccgggttttctgctccacttgcttcgagaaccttcatactgtttcgaaattcggttgcggtgagatggccttgaatatagaggaattttgcaaagtccatcagtttatctgcacaatctgtttcatattttttcacttcagcaaaacgctttcttaagtatgatacgttcataatggtgcatcccctctcatgtatgttgagattatgttaacataacgattcgacttttttctgtttttaaaaaattaagactttcgacagcatttgacaaagatcagaatcaccgaaagcacataaccaaggcggaattcatacatatatagcagaaacttagtgagagacaagggggaatgtcatatgcaatggagagcgcagccatatcaaaatatgtaccagcagccggcgggatatttctacccgcagcagatacagccattacagccgccgtatccgcagcagatacagccattacagccgccgtatccgcagcagatacagccattgcagcagccgccatatcatcagcaagggcagtacccgcagcaattttatccgaatcaggaatacggtcatatacagcagccgtttgctcctgctcctcctcaggcaggcatgcccgggggccagccggggtttgtgaatccttaccccgttcccagaccgaatcagcagcagtcttcccaattctcaggcatactctcccagtttaaaaaaacgaatggacagtttgacttcaataaaatgatggatacaacggggcagatggtaagcgccgtaaatcaggtcggatcgctggtgaaaggcttcaccagtatcttcaaataaaaagcatgaatgatatccatcattcatgcttattttttagggaaaaagagggtaagcgtctgttcattccaggatgtttccatatcttcttcacttaccttatacgggaggacaacggttcttgtcatgcttgaagacacatgggatgattgagcctgtttatgatcgtagcggattgtaacgtgaaggtagcaccctttcgtttccaccagcatatccccgtcacggaacgtctcgggaacgccgatatcaaccgcgagccccgtcggctcttctctgacgtcaatcgtcacttgcgcttcagtaaaagccgaattgacaaggtgctgaaaaccctgcatcaattctgcgaagggacctgagtgaaaaaattggtccatcgcatggctgatgatgtcctcattactttgcggatcaagtttatcgttttgggattgatccatatgaccaccgcctttttacaaacagactatgcgatgctatgccgtatggttaagaattgaaggaaaaaagaaagtatggttaaatagtggagaataaactggtaacggattcacatttaggaaggggagcacaacacattgctgaaaaaattattcggattgggagacagccggaaaaagccggccgaggaagtgattttttctccggctgacggagcggtgatggatttggcttcagtgccggatcctgtattttcacaaaaaatgatgggggacgggatcgccgtcgagcctgcaaacggagaaattgtttcaccggttgagggagaagtgattcagctgttccatacaaaacacgctgtcggcatccgcaccctttccggagcggaacttttgatacatgtcggtttggataccgtcaatatgaacggcgaaggctttgaagcgcatgtaaaagaaggagacaaagtgaaaacaggcgatctgcttttaacgtgccggctggatttaataaaagaaaaagcaagcagcaccgtcatccctatggtgattatgaatggcgatgccgcagaacctttgcaatttgcaggcgcaaatgaagcgaaaaaaggacaaacagagctttttacgataaaaatgaagtaggcaggggctgattccctgctttttttcttgtgcaggattttcatctagccaggcaaacaaatattcggtaaactgtacctcataaagaggtgtgaacgatgaagaaaaaatcactgagcgaactgattcaggaattaaaaaatcatgaaaatattgtgcattggcatgaagaggaaccgcgggaggcgaaaaccatgccgatgccggagcaagtagatccgaacattcgggcggctctcgaaaagagggggatcgagcggctttttacacatcaatactccgcttttcagacggttcaaaacggagaaagcattgtggccgtcacaccgacggcctccggaaaaacactgtgctataatcttccggttcttcagtctatcgcggaagatgccacaagccgcgcactttatttatttccgacaaaggcgctcgcgcaggatcaaaaaagcgagctgaatgaaatcatagacgagacgggcatggatattaaaagcttcacctatgacggagatacgtctccggctatcaggcagaaagtcagaaaggccgggcatattgtgatcacaaatcccgatatgcttcattcagccattcttccccatcatacaaaatgggtgagtctgtttgaaaacctgaaatatatcgtcattgatgaattacatacgtaccgcggtgtattcggcagccatgtggcgaacgtcatccgccgtttaatgagaatctgcgctttttacggaagcaagccgtcatttatctgtacatccgccacaatcgccaatccgagggagttggcggagcagctgacgggaaaatccgtgcgcctgattgacgacaacggtgccccggcaggaagaaagcactttgctttttacaatcctccgattgtaaataaaccgctgcatattcgaaaaagcgccaccgtggaagtgaacgaacttgccaaaacttttttaaaaaataagatccagacgattgtttttgccagaagccgtgtccgggtcgaaattattttaagccacattcaggagatcgtaaaaaaagaaatcggcgcgaagtctgtcagaggctatcgcggcggatatctaccgaaagaaagaagagaaatagagcgggggttaagagacggcagcattctcggcgttgtcagcacaaacgcgctggagctcggcgttgatatcggccagcttcaggtctgcgtgatgacggggtacccgggcagtgtcgcgagcgcatggcagcaggcgggccgggccggacggcggcagggtgaggcgcttatcgtgatggtggcgaactctgatccgattgaccaatatattgtccgccatcctgattatttctttaaacgctcgcctgaatctgcaaggattaatcccgataatctcattatattggtcgaccacctgaaatgcgccgcatatgagctgcctttcagagccgatgaaacattcggagaaaatgatgcgagggacattctcgagtatttagaggaagaaggggtgcttcacgaaaaccgcgaacgctatcactgggcgagcgaatcttttcccgcctccaatatcagtctccgttcagcgtcacaggaaaacgtggtcatcgttgaccggtcagagacggctgatgtaaaaatcatcggagaaatggaccgcttcagcgcgatgacgcttcttcatgatgaagcgatttatcttcatgaaggggtgcagtatcaggttgaaaagcttgattgggaccataaaaaagcgtacgtgcgaaaggtcgatgtcgaatattatacagatgccaatttagcggtgcagctgaaagtgctggacattgacagaacggacagcagaaagaaaacggccttacatttcggcgacgtcaccgtgaacgcacttccgacaatatttaaaaaaattaaaatgacgacatttgaaaatataggatcaggaccgattcatcttcctgaagaagaactgcataccagtgcagcctggcttgaattaaaagaaacggattcggaaatcggcgaaaaaacgcttgaacagctgcttttaggcattgcccacgtcctgcagcatatcgtgcctgtatacgtcatgtgcgatcgaaatgacgtgcatgtcgtgccgcaaatcaaagccgcacatacgggacttccgacaatctttctgtatgatcattatccgggcggaatcggacttgccgatgaagtatataaacgatttgatgaaatcaatgaaggggctgagcgcctgatccgacaatgtccatgtcaagacgggtgtccttcctgcatcggctccgaaatagaaggaatagatgcaaagaaagcgatactccggctcttgaattacgtgtaaaagaaaagggggacgaaagatgtccttgaaaaataaattaaagcggatgaaaaaccacttgaatgtgccggaagctgaaaaaaagccggcagcttcacaactttcggtcccggatattcaagtcccgtttagagaagaatgggaggcactcggagtgaagcctttcttttttgaggatgaatactgtcttatccgcgaaaccgtctatccgctttcgcaccgccacggacggtacagcttcagtgaacttgatgacgtcatggcattatggaataaaggcggtttgacacatactttatcagcagaaggatacgaaaaaagccagctgttcttctttgatactgaaacgaccggcctcggcggcggggccggcaatatgatctttttgctcggccatgcaagagtgtatgaagaccgtgtagcggttaaacagcatctgctccctaaaccgggaaacgagacggctctttacaaaagctttttaagtgaggttgacattacgtcccttgttacgtataacggaaaagcctttgactggccgcaggtaaaaaccaggcatacattgctgcgggacaggcttccgaaacttcctgacttcgggcactttgatcttctgcacggggcgagacggctttggaaacataaattagagcgtgtatcgctttcggcggttgaaaatgaagagcttgcttttaaaagggacgaagacacccctggttatttggcgccgatgctgtattttcaatttttaaaggcggaggacccggctcttttaaagggagtgctctcgcataatgaacaagatgtgctttccctcatcgctctttacatccatatgtcaaaaaagatttttgcatcttctgatcagacgtcagaacgtcaggaagcatacgccatggcgaaatggtttatcgctcataaagaaaccgatcgcgccgttttgcagctggaagcgctgcaaggcaaagactttgaagattcggatcgggccctttttgacttagcgatgctttataaaaaacaaaaccgcaggcaagacgccgtgcccctttgggagaaactgacggactctgatcttcacacatgcagacaccaatcagcggttgagctggcgatctattttgagcattacgcaaaagattacaaaaaagctctgcaggccgcgcagcaggcggcagaagacggggaaatatcggaaaaagaagccgagaagctccatgtgagaattgcccggctcaagaggaaatattcctcttgaaatattgcccgggaaagcgcaaaagccgagctgtttcgccaaaaatatttttttctgaatccgcatcgattttgttgtagaatggtgccgcatcttgtaaaatagcgttagttatttataggggagagttggtatgtataaaggtgttttttacttgttctttgtcgtggtttttttgattgcgtttgtattttcgaattttaaagacagtttgctgacacacttttaaattgggtgattgaattagaacatgcaccctcttttcttcataacctaacagtgtaataaaagttaatggagaggggatttagcatgtttcatcatcattgttgcagaccaaacgtgatgccgccgattgtccatccgactcattgctgtgaacaccattgcttttctaacacggttgtgccgcatattcatccgcaacatacaactaacgtaaatcaccacaactttgagcacgttcattactatccgcacactttttcaaatgttgacccgacaactcaccagcattttcagtgcggaagcccttgctgcgatcattagtattgaacgcttaagcaagatcggttaggatatcagcaaatcaaaatggggcccgatggggagccccattttttaagcaggtgatcaattgaaagtattagccgtaacggggtacaagccgtttgagctcggtatctttaaacaggatgaccgggcgcttgtttatataaaaaaggcgatagaaaccagactcagaagctttattgacgaaggcttggaatggattctcatatccggacagctggggactgagctttgggcggcagaaacggcgtacgatctcagagaagagtatccggaattaaaggttgccgttatcacgcctttctacggccaggaagaaaagtggaaggagccgaataaagaaatgtatgaagcggtgcttgctcaggcagattatgaggagagcctgacgcatcggccgtacgaaagtccgctccaattccggcagaaaaacgcgttctttattgaaaagtcagatgcgcttttgcttttatatgatccggaggtggaaggatcgccgaaatatatgctgcagcaggcagaaaaacgccgtgaaacagacggatatccgatttattcgattacgatggatgatctccgtgccgccgttgaggaagaagatttctttacataacacgtcagagaatatttgacaacgggacgtgtttctgaataaaatataacatgatgattcacgatatgaggtgaaaaagatgcttgctgataaagtaaagctttctgcgaaagacattttggaaaaagaatttaaaacaggcgttagaggttacagacaagaagacgttgacaaatttttagatatgattattaaggattatgaaacctttcatcaagaaattgaagaactgcagcaggaaaatctgcagctgaaaaaacagcttgaagaagcaagcaaaaaacagccggtgcagtccaatacgaccaactttgatattctgaaaaggctgtccaaccttgagaaacatgtattcggcagcaaactttatgacgaataaggcagatgcacttgtcaaatgagacaagttgctttataatgaacaagtgttcttaacgttcgggtaatcgctgcaggtctttgaatctgtagaggaaagtccatgctcgcacggtgctgagatgcccgtagtgttcgtgcctagcgaagaaataagctagggcagccttgataggctgacggcaggaaaaaagcctacgtctccggatatggctgagtatccttgaaagtgccacagtgacgaagtctcatcagaaatgttgagagtggaacgcggtaaacccctcgagcgagaaacccaaattttggtaggggaaccttcttgaaggaactgaacagatagaaggacagaatactttctgtagatagatgattgccgcctgagtacgaggtgatgagccgattgcagtacgacggaacaaaacatggcttacagaacgttaaacattattgatatgacaaattagagctctcctttaaaggggagcttttatcttgaatgaaacgaaagcttaaaagagacagggtgatacgatgaagaagtacacactaatagcgacggcaccgatgggaattgaagcgatcgtcgccaaagaagtgcgtgatttaggttatgaatgcaaagtagacaacggaaaagtcatttttgaaggagatgcgcttgcgatctgccgcgctaacttatggctgcggacggctgaccgcatcaaagtacaggtcgccgagtttcaggcaaaaacgtttgatgagctgtttgaaaaaacaaaagcgattgactggcgcgcgtacattccggaaaacgcaaagttccccgttatcggaaagtccgtgaaatcagtgcttgccagtgtgcccgactgccagcggatcgtcaaaaaggcgatagcggaaaagctgaaacttcaatcaggaaaacaaaatgaatggattgaagaaacgggacccgagtataaggtggagatttcccttttaaaagataaagccgtacttacactggattcatcaggaacaggccttcacaaacggggatacagggttgatcagggcggagctccgattaaagaaacgctcgctgccgcgttaattctgttaaccaactggacgcctgaccgtccgttcgtcgatccgttctgcggttccggcacgatcgccatcgaagccgctttaatcgggcaaaacattgctccgggttttaaccgtgattttgcttcagaagactgggaatggatcggaaaagaactgtgggacaaggcacgccttgaagtggaagaaaaggcgaactatgatcagccgctgcagatctttgccagtgacgtggatcaccggatggtaaacatcgccaaagaaaacgcagaagaagcgggacttggggacctgatcgaatgcaagcagatgcgagtgcaggattttacgacgaaactcgaattcggcgttatcgtcggaaaccctccgtacggcgaacggctcggcgaaaaaagggaagtcgagcagatgtataaagaaatgggccgggcatttgaatctcttgatacatggtctgtctacatgttaacgtcaaatgaacaatttgaagaggtctacggaagaaaagcaacaaaaaaacggaagctctttaacggttttatcaaaacggattattatcagtactgggctaaagtgcggccgcagcggaaaaagccgcaacaaagagaagacgcctgatacagcgtcttctccggcatctttacgttttattctgccattaccagcggtgcgcttttgcgttgctccgtaaaataatgttggtctgggacatttcggtgtggccgttcacctgcgatttagagcgtttcggccgcgtccaattgtgatgaaacaattcagaatgctgatctaatcgatctttataactcatgtaaccatcactcccggatagaataattttgtgaagatggatattcgatcgaatatctgttgtagtttgtgcaggtcaggtgcggatcattcaggatggcatgtatagaaagtgaagcatcggcatagaatgatgattatttctatttgagaggtgatcttattttatgctgaacagcgagcacttcagtaaaatacaaaaggcgttagacgcaactgctttccggctggaggaagccggagcggagttcggtccttccgccatgacacacgcacaggaagaacttgaaaatgcggtaaaacatacacattcaacagaccatccgttcctatgtacacatatcattaaccggaaatgataatgacaaaaacttggcgaggccaagtttttttgttgtattgaaaagggttaaatgatattatagatggtctgaatgccgaatagttaggggttggagttgggtgacaacatcacgtttgccttttgctttaacaaaagaaaagaatttttacgaagaattgaacaattggattggtgacgtgttttacgatatccttcccgagaaaggctttgaccttcgggatgagcaggtatttatggcgtttcagcttgaacgggcatttaaagagaaaaaggtcatgttcgctgaggcaggagtcggtacggggaaaacgctggtgtatctgctgtttgccatcagctatgcaagatatacgggtaaaccggccattatcgcatgcgccgatgaaacgttaattgaacagcttgtcaaaaaagaaggcgacatttccaagctgacagaacatttggatctgcagattgatacacggctgtccaaatcccatgagcagtatctctgtctgaaaaagctggagaaaacgatgcagcgttctgatgatgaaaagtggctggatctttatgagtcgctgccttccttcgtacacgaatcacaagcgatgcagcgcttttatccgtacggcgaccgcaaacagtacgctgatttgacaaatgaggagtgggcaggcgtcagctatgattccttccaagattgtttaacttgtgatatgagacatagatgcggtttaacactttcgagagatcattacagaaaatcaacggatctgattgtttgctcccatgatttctacatggagcatgtatggacggaagaatcacgcaaaagggaagggcagctgccgcttttgccggatcacagcgccgtcgtgtttgatgaaggacatctgctggaattcgccgcgcaaaaagcgttaacgtatcgtgtgaagcagtcgacgcttgagctgtttttagagcgtctgcttcaaaatgacatcagagaggaattcgccgaactgattgaagatgcccttgccgcaaacgatgagtttttctatgtgctgtcagaggaatcgaaggaaatcgccggctctcaccgattggacatccaaaacgaccagcgtgttaagcgtgcggctgacgaactgtgccgtctgctcgataaaatcggcgaggcgctcgtatttgaatcggaaatgtatacgattgataagtacgagctgtcagtcgtagaagaatacgtagaacaaatggcatattcgctgtcgctgtatcaaaaggatgccatcagctggcttgaaacgcgggatacagactcaacgtttgtcgttatgccgagaactgtagccgaagttttgggagaaaaggtcttttctaaaaagattccttatatcttctcgtcggccactctttctgagggcggttcatttgattatatcgctgacagtctcggaatccgtgatcctttatcatttaccgttgaatctccgtacgattacgaggagcaaatgtctgttgcgcttcacggtgacatgacgtctgagcagaaaacagccgaaacgattgaaaccattaaggagaatgaaggacgcaccctcgttcttttcccttcctttgaagacatgaaggaatttaaagaacaggctgccgcgtgggagctgccgtatccgatttactacgaaggtgacgaagagatcagcagtctggtcgaaaaattccagcgggatgaagaatccgtgctttgttccgtccacttatgggaaggtcttgacattcccggtgactcgctccggaatgtgaccatttgggcattgccgtatccgcctcatgatcctgtgtttaccgcaaagcggaacggagcgaaaaaagatccgtttgaggaagttgatctgccgtacatgcttttgagagtccggcagggaatcggccgcctcatccgttctaatcaggacagcggaaccatatccatttatgcgggcggagaaagtgaacgggtcctggccgaagtcaaaaaggtcttgcctgttacaccgaaaatcgtataaaaacaagagctgcaggaatcttatcctgcggctttttttaatccgggaagttgactttatgacggcgttccattagcctgtaattgatagtgaaaagggaggggaacggatatggatgtacatacatatgaaaaagagttttttgatctgttaaaaagagtatcccactatgaagaagccattgcgctcatgcattgggacttaagaacgggagccccgaaaaaaggctctgatgaccgggcggaaagcatcggacagctgtcggctgacgtttttcaaatccagacatccgaccgaatgaaagagctgatcgacatccttctcgtgcatgcagaagagctctctgaagatacagtgaaagcggcggaacttgcgaaaaaagattatgatcataataaaaaaattcctgaagatgagtataaagaatatgtcattttaacatcgaaagcggaaacggcttgggaggatgcaaaggcggcctctgatttctctatgtttgctccgtaccttgagaagctgattgattttaataagcggtttatttcttactggggctatgaagatcatccatacaacgcattgctcgatattttcgaaccgggtgttacggtaaaggtgctggatcagctgttttctgaattgaaggaagcgatcattccgcttatcaaaaaagtgacggaatccggcaataaaccggacacttcctttataacgaaaacgtttccgaaagaacaacaaagagacctctccttgtatttcttaaaagagttcgggtatgattttgacggcggccgcctggacgagacggtgcatccgtttgcgacgacaatcaaccgcggcgatgtgcgggtgacgaccagatatgacgaaaacgatttccgcacggcgattttcggaacgattcatgaatgcgggcatgcgatctacgagcagaatattgacgaagcgctgagcggaacgaacttatctgacggtgcatccatgggaattcatgaatcccaatcgttattttatgaaaactttatcgccagaaatcaacatttctggaccgcctattatgaaaaaatggttgaggcttcgcctgatcaatttcaagatgtgaaaagagaggactttgtacgcgccgtaaatgaggcgaaaccgacctttatccgaattgaagccgatgagctgacatatccgcttcatattattatccgttatgaaattgaaaaagcgattttcagcaatgaagtgacagtggaagaactgcctgcattgtggaatcaaaaatatcatgattatttaggcattacgccgccatctgacgcaaaaggcattttgcaggacgtacattgggcgggcggcgatttcggctatttcccttcctatgcgctcggatatatgtatgcggcacagctgaagcataccatgcttgaggatctgcctgaatttgatcaattaatagaacggggcgactttgagccgatcaaacaatggctgacagaaaaggttcatcagcacggaagacgaaaaatgccgcttgacatcataaaagatgcaacgggagaagagctgaacgttcaatatctcattgagtatctcgtcggcaaatattcaaatttatatttataaacgaaacgcccggtatacaccgggtgtttttctaaaaattctaaaaaggcgaataatcgaaaactaattctttgtaaaagttcggaaatattcaaatttcactatgcaaaagaagtgtatcttgttataatttgattaatatcatacgaacactcatataatcgcgtggatatggcacgcaagtttctaccggtcaccgtaaatgtccgactatgagtgagcaatgggacggctttattcggccgttacgtgtagatcattcggcattgcttgctctttttttggagagcgggcaatgctttttttattttttataagcgggggtaatcattgtggaagcattaaaacgaaaaatagcagaagacggaatcgttctttctgatcaagtgctgaaagtggattcttttttaaaccatcaaattgatccggttctcatgcagcagatcggccgggaatttgcgcgccgttttgaaaaagacgagataaccaaaatcgtcacaattgaatcttcgggcattgcccctgcggtaatggccggccttgaactcggcgttcccgtcatctttgcgagaaaaaggaagtctctcacgttaacggatgatctgctgacggcgtccgtctattctttcacgaaaaaaacagaaagtcagattgcaatctccggaaatcatctctcgcaagaagaccgcgtgttaatcattgacgactttttagcgaacggacaggcggcagaaggacttttgtccatcgtaaaacaagcaggcgcagcggtttgcgggatcggaatcgtcattgaaaagtcatttcagccgggaagagacgagctggtgaaaaaaggatgccgggtcgaatcactggcgagaattcaatcgcttgaagacggaaaagtgacatttgtacaggaggtccgttcatgaaaaacggctatgccaaaacactttccctcggtatccagcatgtgcttgccatgtatgccggcgccgtcgtcgttcctttaattgtaggagcggcattgggactgaacgcagaacagctgacatatctcgtatcaattgacatttttatgtgcggggcggctacgctgcttcaagtatggaggaataaatgtttcggcatcggcttgcctgttgtgctcggctgtacgttcaccgcggtagcgccgattatttccatcggtaaggagtacgggatttcagccatttacggaagcattttggcatcggggctgcttgtcattctgctgtcgtttttcttcggcaagctcgtatccttttttccgcctgtcgtaaccggatctgtcgtgacgattatcgggatgaccttaatgccggtcgcgatgaatcatattgccggcggggaaggcagcaaggatttcggtgatccggctaaccttgccctcggatttacggtgcttgtcatcatcgtgctgctttatcggtttacaaaaggatttttgaaatccatttcaattttaatcggcattgtcatcgggacggccatcgcatattttatgggaaaagtgcaatttgacaatgtggcgaatgctgacgccattcaaatgattaaaccgttttatttcgggacgccgacatttcatgcggcaccgattattacgatgtcaatcgttgccattgtcagccttgttgaatcaaccggcgtctatttcgctctcggtgacctgacaaacaggcgcctgtctgaacgtgatttagcaaaaggctaccgcgcggaaggtctggcggtgttcatcagcggcattttcaatgcttttccgtatacggcctattcccaaaacgtcggtctcgtgcagctgacggggattaagaaaaacgcggtcatcggtgtcacgggcgcacttttaatgctattcggcctttttccgaaaatcgcagccttcacgaccatcatcccgtcttcagtactgggaggcgcgatggtggccatgttcggcatggtcatttcctacggcattaaaatgctcagtcaaattgactttaaaaagcaggaaaatcttctgatcgtcgcgtgttcggtcggattgggactcggtgtaaccgtcgttcccgatatgtttaagcacctgccgtcttacttaaatctgctgaccacaaacggaatcgtcgccggaagctttaccgccgtgcttttgaatattgtgggggacaaacggttcaccgattatttggcggaagtccgccaggcggcgcttgaggcgtatgagcatcaggactacccgtttgaagagcttgtggagcggatcggcgtgcagcgggacacaagccgtaatccgctatttgatgccatgcttgtcgttcagaatatggaacatgaggaattgctgttggacggtttgcatattcagcctgcggacgtgtcccgtccggtttccaaatttgatgtcactttgcaggcttctgaaggcgggggacagattcattttctgtttgaatatgcggcgtctttattccggaaagaaacgatgcagcgctgggcttcccactttatgacgatgcttgaacacattgtccgtgaaccggaaacttctatacaagcgatcagcatgctgactgctccggaacgggaccgaattctttcggactttaacggcatgacggataaacagctgcctgaaaaaacagttcatggactgttcatcacccaggcgcgaaaaacaccggatgcggcagcccttatcagcggggaaacgttggtcacatataaagaattagatgactggtcgaataaaatcgccagagctctgcaaaaacggcagatcggaccgaatgccgccgtcggcattgtgataccaagatcgccggaacaagtcgcggcagtcttcggggtttggaaagccgggggcgcctacgtcccgatagatcctgaatatccggaggaacgcaagcaatatatcatttcagacagcggcacagcgcttctccttaccgcacacggcgcaatagatcaagtgcctgatcattttaaaggtgaagtgctcgcactggaggatatccaagaacaagacgcatcaccggttcagccattatcagcaccggaagatttggcttacatcatttacacgtccgggacgacaggcaggccgaaaggggttatggtcgaacatcgttccgtcagccaaacccttcaatggcgaagcggattttatgatctgaatgagaaagatacggttcttcagctcttttcattttcatttgacggttttgtaacaagtatgttcacaccgctgatttccggtgcgaaagcagccgttttagccgaagatgaagcaagagatattcttgccattaaacactatcttgcatcttaccgcatcactcatatgatcattgttcccgtactgtaccgtacactgcttgacgtactggagccgggggatgcagagtctctcagaattgtcacattagctggagaagctgtcgaccaaaacattatcagccgcagtttatcggtttgtcctcacacggagcttgccaatgagtacggcccgacggaaaacagcgtcgccactacagcggcaagacatatagaacaaagtgagaacattacgatcggccggccgattgagcattcacacgtttatattttaaacggggatcacccgcagccgatcggtgtaacgggagaactttgcatttcgggttccggccttgcaagagggtaccgcaatcttcctaagcaaacggcccaagcctttgtccaagacccgttccagaagaaccggcgcatgtaccgcacgggcgatcttgcaaaatggctgccggacggcacgctgcaatatatcggccgaatggacgagcaagtcaaaatcagaggctaccgggtggaactgaaagaaattgaatcggccttaacaggcataaaaggtgtcaaagaagcagccgtcaccgctcataccgcatcagcaggccaaacggaactatgcgcttatatcgtgacagaagaaggaacagaaagtgaaaccgtgcagcaggcgctcagaaatgaaatgcccgcttatatggtgccggcgttctttgaaacacttgaagccctgcctgtcacaccgaacgggaagcttgaccgccgcgcgcttcctgagccgcggaaaaaagcgcacaccggacgggcatttacggagcctgaaaacgacatggaaaaagagctttccgcgatttggagcgaagtgctcggaactgaaaacattgccgcggatcaatcattttttgaactgggcggcgattccatcaaagccctgcaagtatcagcccgattacatcaggcaggaaaacagatcgccgtaaaagatattttcagccggccgacaattagagagctggctccttatgtccgtacagagcggcagccggtcagccaagctcctgcagaaggagaagtgaagtggtcgccggttcacaaatggttcttcacacaagacatgaaggaagcaaatcattttaaccagtccgtcatgctgacaagaacaaattcaatagatgaagaggctctcaggaaaacgttaaaagccattaccgttcatcatgatgccttgcgccttgtctgcaaaaaagacgaagagaaaggtcttctcctcttcaacagaccggctgacctcgcagatgagcagctttacaacctgaccatattagaaacggaaggcgatgagcatgagaaggaacgttttataaaacgccgcgtcgcagagcttcagagaaacatggatttggagaacgggccgctggtacaggcggggctgttccgctctgaagcagaagattacttgtttctgacggtccatcatctcgctgtcgacgggatatcatggcggattttattggaggacttggcttctgcttatgagcaggccgcctctggacaggaaatcaaactccctccgaaaaccatgtcattcaaaacatatacggagcagctggccgattatgccgaaagcaaacagcttcttcagcaggcggagtattggcgggagattgaacactatgaaacagaaagtcttccttacgagcaggcagatctatctcaaactcctgcaaaaaaacggaacacggtatccttcactctgacagaaagtgaaacggacgccctgttgaaagatgtacacagcgcctacaatacggatacgcaagatgtgctgttgacttccgccgtgcttgcccttcaaaagtggtcgccgcggcacgctttgaaaatcgcccttgaaggacacggacgccaatcggagcaggcaggtgcggacatcagcaggacagtggggtggttcacttccatttacccggtgcttgtccggagcggagtttatgaacctcttgaagaatatgaaattcgcacattgaaaaccgtcaaagacacattgcggcgcattccggataaagggaacggatacggcgtcctcaaatatttaacaccgccgaagcttgccgggatgactttcgggaaaacaccggagatcagctttaattatctcggacaattcgatgcgcccggcgggagtccggcagaaacggaacagcctgacgcgtttcagttttctcctttgggaggcggagatgatgtgacagatacatggaaacgggagcagtcacttgaaatcagcgcgattgcggcaaaaggccggatgaccgtcagcatttcctatgaaacggaacgcttccggcaagctacgatcgaacggctgtccgaaagctgccggtattatctcctgaaactgtcggaacactgcctcagcaaaaccgatacggagaagaccgtcagtgactttgatgatcgggagctgactgaggaagccttgcaggatattgccgacttactcagcttccactaaaccgagcgggaggaacacatggacaaaacaaaaaatatccaaaatatttatcccctcagccgaatgcaggaaggaatgctttttcattcctttctgcaaaaggagggggctgcatatatcgagcaatccgtcttcaccataaaaggccggcttcgtccggaattgtttgagcaaagcgtacagtctgtcatcagccgtcacgatattttcagaacggtttttttacctcatgtcgctcagctgaacggcccccgccaagtcgtgctgcgtgagcgggaattccggctgcaccgcgaagatcttacacatttggatgaagcggaacagagcgcctacttacagcgatttaaggaacgtgaccgcttaaaaggctttgacttgcaaaaggatatgctgatgcgtgtgtctttgtttaaaacggctgaggaaaaatatgtatgcgtctggagccaccatcacatccttatggacggctggtgcctcggcatcgtccttcaggaattcatgcatatgtaccgggcgattgaatcaggctcacccgtcacactggcgcccgcaaagccttacagcacgtatattacatggctgactgatcaggacaaagacgcggcttctgagtattggaaaggatatttagcaggctgcgagacaccctcaggactcccgaaaatatcggcccgtccccaggaaaaaggctaccgtaagaaagagctcctgttttctttagatcaaaatctgacagacaggctgaaaaccatcgccaaagaagagggcgctacgctcgcggttcttatgcagactgtatggggcctgatgctgcagcgatacaaccggacggacgatgccgtattcggcgccgtcgtatcagggcggccttccgtcattgacggcgtggaaagcatgatcgggctgtttatcaatactgtgccggtacgcattaaaacgggtgacgaaagctttagagaactgctgggacgctgccagaaagaaatgcttgattcagaggcgttcagttatcatccgcttgctgacatccaatctcagactgagctgaaacaggatttaatcgaccatatcatcgtgtttgaaaattatccgattcagcagcagatgagagacgcggaaaaggaatcggatgcaccgttccggatcgggaatgtcaatgtttcggaacaatcgggctacgattttaacctcatcatagcgcccggcgatgagctgatcatcaaattcagctacaatgcgaacgtttatgacgaagtatggatagagagcgtaaaaggacacttggaagaggcgctgcgcggcgccgccttcaatcccgatgtttccgctgatcggcttccgatgctcggacaaaaggaaaaatcaagaataatcggcgaatttaatgacacgaaaacaacgtatgaaagagacgaaagcatcatcagcctgttcagccgacaggtgaagaaaaccccggaccatcaggcgcttcacgccggcgggctgacgatgacgtaccgggagctcgatgaacggtcaactgcgttcgcccgcatcctgctggaaaacggtttggcgccaaaaggaattgccgggattcttgccgaacgctcaccggaatttatcatcgctgttctcgctgtattgaaagcgggagggacgtaccttccgctcgatgcagaactgccatccgacaggatcgccgatatgctcactgagagcggagcacagctgttaacggtacaaaaagggattgagactgacattgacttttctcacatcatctctatcccggctgcagctgaaaaacaaacagctgaggcgggtaaactgaataccgttacgtcacctggtgacctttcctatattatgtatacttccggttcaacaggaaaaccgaagggcgtgatgatttccaaccgcaacgtcgtatcgctcgtgtcaaacagtaattacacgtcagccggcacgacggaccgtctcattctgacaggatccatcggttttgacgcagtgacgtttgaaatcttcggagcgctattgaacggagcgtgcctccatgtggttgaccgcacgacaatgcttgcccctgagaggttcggcaattatctttcttcaaaccgtattacgattctgtttttgacgacggcgctttttaaccagtttgcccaggcggatccggagatgttttgcggattgcacaccttatatgtcggcggagaagcattgtccccggcgctcatcaataaggtcagacaccgctgtccgaatctcagcctttataacatatacggaccgacggaaaatacgacattttccaccttttacgaaatcaggcacgatttttctcagccgatcccaatcggaaaaccgatcagcaattcaaccgcgtatatcattgataaaaatggcggacttgcaccgatcggcgtgcccggtgagctttgtgtcggcggggacggggttgccaaaggctatttaaacaggcctgacttaacaagtgaagcatttgtcagccacccggttcatcctgaagaaaagatctacagaacaggggatttggcacactggctgcctgatggaagcatcggatacatcagccgtatcgaccgtcaattcaagattcgcgggaagcgtatcgagccggccgaaatcgaagcgcggctgactgaaattgatggaatcagggaagcggcagtcatcgtgtcagacgaaggacaagaagcaaccctttgtgcgtattatacaggcgcacatgctgaagaaagagccattcgatccctattggccaggtcgcttcccgactatatgattccgcagtatgtgatgaagcttgaccgtatgccgcttaccgtaaacggcaaagtggaccgccgcaggctgcctgcgccggaacggaaaaaagcttcatcaaaagccgttccgccacgaaactgggtagagcgtgagctgatcgacatttggacgccgatcctcggctgcggggagctgggcatacaggatgacttctttgagctgggcggccattctttgaaagcattgcaagtgattcatcagctgaagaccaggcagcagatggatgtgccgattgaaatgatatttgaatatccgacaattgaacaattggctgaaaagctgtattcaaacacactgtcagaagctgccgaacagcatatcagcagactgaatcagccgaaaggccgcaatcttttctgttttccgcctatctcaggtttcggcattttctttaaagatctggcggcggcattaaatggacgggctgctgtgtacggttttaactttattgaagaagacagcagaatggaacaatacattgataaaatgctggaaatccagccggaaggcccttatatcctcttcggatattcagcgggcggcaatacggcattcgaggctgcaaaagcgatggaaaagcgcggcttagaaatcagcgacgtcattatcgcagacgcgtacagaaagcttgacgcactgccgccgcagccaacaaacgcaacagccgaaaatgtcccggaagccgtcagggaagcggtcatcagaaaaacagagcgctatcaaacgtactgggcggaactgataaatgacggccaaattgcggcaaatctccattttattgaggccggcataaaggaagagcacagtgataagaccgagccggtgaaatgggaaggcgccacaacgggagtctatcaggaatatcaaggcggcggcgcccataaagatatgtttgaacccgcctttgcacagcaaaatgctgaggtcatactggacatcatcgcaaacagcggaagacgcttggcgcggaatctgtaacatccggcagaatgactgaagaagacaaagggcaagataggggaatcaaactcagttttttttggaggctttgagatgacgaacctatcttggcttacgtatgtaatgattattcttgccagctaccggctgacccatttgatcgtatttgataagattacggaattcataagaaaaccctttataaagcaagaaaaaaccgtcgatcaaaacgggcgcgccgtccaaaaaaaagtcccttcctccgcattcggttatatgctgcaatgttattggtgtgcgggcgtctggtgcgccatattgatcggcatctgctatttggtctggccccgctatgcacatccggttattttcattttgtccattgccggagcgcaggccattcttgaaacatgcgtcggcgtcggaacgaaggtcattgacgtgctcgccgccataaaacataaaaagtcctgaagcgttttgattcgctttaggacttttttctttcccttttaggctgagaggagcaaagcaggctttctgattcaccgcccggaatgcttcggaataccgtaaagcagagagggggaaaaacatgaaaagctgccgttttagcatgatatggtttttggccgttgtactgacagccggcatctttacgttctcagcatccgcacaagcaagcggcactcagccggagagagaaatgcgagccgtatggatcgcgtctgtcaccaatatcgactggccctctaaaaaagggctgtcaccggaagagcaaaaaagagaatacagcaagctgctggatgacgttcagaagatgggaatgaacgccgttatcgtccaaattaagcctgcggctgatgctttttatccatcagattacgggccttggtcagagtatctgacaggaacccaaggcaaaaatcccggctacgatccgcttgcttttttagttgaagagacacataaacggaatcttgaatttcacgcttggttcaatccttaccggatcacgatgaatcacacaaatttgaatgcgctttcagatgatcatcccgcgcgttcccatccggactgggtcgctgcatacggaaaacagctgtactataatccgggcattccggaagtaagacaatttataacggatggaatcaaagaagtggtcagccgttatgacattgatgcggttcatatggatgattatttttatccttataaaattgccggacaggaattccccgatcaggcggaatacgaacggtacggaaaagctcactttgcatcaattgatgactggcgcagggataacgtcaaccggcttgtaaaagaaatcaacgaaaccatcaaacgagaaaaaccttatgtcaaattcggaatcagcccgttcggcgtatggagaaatgccgcagatgatccgacaggctccgaaacggccgccggggtgcggaactacgatgacttatatgctgatacaagagaatggatccaaaaaggatacattgattacatcgcaccgcaaatttactggagtatcggatttaaagcggcggcatatgacgtcttagcggattggtggggaaaagaagtgaacaatcggccggtgcatttatatatcgggcaggctgcttataaaatcaacaacaatactgatccggcctgggccgacccgggggaatacggaagacagattactctaaacagaggatcagcatggataaaaggcagcatgcatttcagtttaaaggatttaaaccgtaatccgctcgatgtgaaaaaccgtttgatcaatgacatgtacagccggcccgcattaattcccgagatgccttggctcggacattccgctttaaaaaaaccggctgtcaaacgggcggagaagaatgcttcaggccatacactctatatcgaagatgcgaaatccaacggtaaaaaaacggcttattacgccatttaccgcgcagaaaagggaaagcagccttatttagtggatacagtcagaaaaacatcgtcacggacgcagacattttcagatactgatattcgggcggaagaagcatgcacctatatcgttacttctgttgacaggcttcaccatgagagccgtccctccgcaaaacggacgattaaatagccattattaataaaactgacagttgcggcactgtcagttttttttgcggcggatgagtccgaatgttcagactttatttggatggaatgaataaagacccccattaataaaatgtagaaagcagcagaaggaggaaggttaatgaattttcaactgacaaaagaacagcagatggtgcgcgaaatggtcagagatttcgccaaaaatgaaattgccccgaaagcccatgaggttgatcaatcagccgtcttcccgatagacacatttaaaaaaataggcgaactcgggctgctcggaattccgtttccggaagaatacggcggggcgggcggtgacaccatttcatatgcagcagcggtcgaagaaatcggaaaagcctgcggcagcacggggctgagctacgcggcagccgtgtcactcggcgcaagcccattatactatttcggtactgaacagcaaaagcaagaacatcttattccgcttgcttcgggaaaagcgctcggatcattcgggctgacagagccgaatgccggttcagatgccggcggcacccagacaaaagccgagaaaaaggacgatgactatgtgataaacggagaaaaatgctggatcacaaacgcaaattacgcccgcacggtcattgtcaccgccgttacgggaaagaactccgccggaaaaccgatcatttcagctctcatcgtcccgacagacacaccgggatttacgatcacaaatccgtacgacaagatgggtgtgagaggatcggatacggccgagcttgtgctggaggatgtcagggtgcctgccgataacctgctcggtgatcctgaaaaaggttttaaacaatttttatatacattagacggcgggcggatctcgattgcggcactggctgtcggtatcgctcaaggcgcactggaggcgtcgctgtcatatgcgaaggaacgcaagcagttcggcagtccgatatcgtcatttcaagccattcaatttaagctggccgatatggcgatggaaattgaccttgccagacaaatggtgcttaaagcggcatggctgaaggatcaaaacctgccatttacgaaagaagcggcattcgccaagctttatgcttcagaaatggccgtcagaacctgccttcaggccatccaaattcatggcggttccggttatatgaaggaatgcggtgtcgaacgtatgcttcgtgacgcaaagctgatggagattggcgaaggaacgtcagaaattcaaagaatggtcatcgcaagacagcttttgaagtgaaatgaaaacgtttactaagacagggatggaagggggcaggtcatatggctgaacttatccatttaacagccggaaagctgcttgagcggaccgcggagctttttccggatcatgaagcggttgtttaccctgagcgcggccttcgttatacgtatgccgagtttgaccggttatgccggcaaaccgcaaaagggctgatgaaactgggaattgaaaaaggagatcatgtggccatatgggcatccaacataccggaatggctcgcggcgcaatttgcaacggcgaaaatcggcgttgttctggtcaccattaatacaaattttcaaatcgcagaactcgattacctgctggcgcattcagacgtctcggccctgataatcatggattcctaccggcagacatcttatgttgagatggtgaataagctgattccggagctgaaaacttgtgagtacggcaggctgcgttcgaaacgttacccctttttacggacggtgttatatatcggtgataaaagcccgcccgggatgcaccgctgggattctttgctgaaggaaggcgaagctgtaacggatgcagcgcttgacggaaggatggacagcctgaaaaaggatgattgcattcatatgcaatatacatcaggtacgaccggatttccgaaaggcgtcatgctctcacattttaatatcgtaaataacgcggccaatatcgcagaatgcatgaagcttacttcaagtgaccgtttatgtattcccgtgccgtttttccactgcttcgggtgtgtgcttggcgtgctggcatgtgtttccgcgggtgcggcgatgattccgatcgaacagttttctccgccggccgttctgaaaacggtggagcaagaagcctgcacggctctgcacggtgtaccgacgatgtttatcgccctcctaaatgacagccgcttttctgaatatgatctttcccacgtccgaaccgggattatggcaggctcgccatgcccggcggaagtcatgagagaagtgatcggcaaaatgggggtgaccggcattaccattgcctacggacagaccgaagcatcacctgtcattacgcagacaagaacggatgattcatttgaaagaagagtggaaacagcggggcgcgcgcttccccatatcgaagtcagaatcgttcggcccggaacatcccaagaagccgaccggggcgaacaaggagagctctgcacccgcggatatcatgtcatgaaaggttactataaaaatcaagaagcgaccgaagaagcgatagacaaggacggctggctgcataccggtgatttggctgtcatggacgaggacgggtactgcaaaatcacgggccgtctgaaagacatgctgatcaggggcggcgaaaatatctatccgcgcgagattgaggaaatgttatatcggcatcccgcagtggcagacgttcaggtcgtcggcgtgcctgatccgaaatacggagaagaggccgcggcgtgggtcaggctcaaagacggacaaaccgcttccgcagaagacatcagaaccttttgcaaagaacatatcgcccgctataaagtccccaggtatgttttgtttacagatgaatatccaatgacagcctcagggaaaattcagaaattcaagctgcgggaaaaaacgattgaagagctcaagttaacttaatgaaaaaggagtgcttcacatttgtttaaaaaagtcctgattgccaacagaggagaaatcgccttaagaattatccgcacctgcaaacgtctcggcatcccctcggcagctgtgtattcagaagccgacagtgacgcgctgcatgtaaaagcggctgatgaggcctatccgatcggtaaatcgagagtaaatgaaagctatttacatatcgacagaatcatagaagccgccaaatccgccggagcggacgccattcatccgggctacgggctgctgtcagaaaacagcctgttcgccgaacgctgccggaaggaacaaatcacatttatcggcccgcccggtgatatcatcgccaagatgggcagcaagatagaagcccgaaaaacgatgcaaaaagcaaaggtcccgatcgttcccggtgtttcagagccattgcccgatgtccactccgccttagccgaagcccgtgccctcggctttccggtcatgctgaaagcgtctgcagggggaggcggaatcggcatgcagatcgtacattcagaagaagagctggccaaagcgttcgaaggcaatcaaaagcgggccgcgtccttttttggagacggcgcaatgtatatggaaaaagtcattgaaaatgcccgtcatattgaaattcagattctcgcagattctttcggcaacaccgttcatctgtttgagcgtgactgttcagtacaaaggcgccaccaaaaagtgatagaagaagcgccgtcgccgtttgttgacgatgaattaagacaaagactcggtgaaaccgccgttaaagccgctgaatcgatcggctaccaaaatgcaggcacaatagaatttctcgtcgaccaaaagaaacaaatctattttttagagatgaacacaagactgcaagtggagcatccggtgacagaagaaattaccggactggatcttgtggaagaacagctgaaaattgccgccgggcaggcgctgactttctcgcagaaagatatcaaccaccgcggtcatgcgatagaagtgcggatctatgcggaagatccggtcaccttttacccgtcacccggtaccatctcgtctttttccgttttaagacacccgtcagtgcgacacgaatgcgccgtcgaaaagggaagcgtcatttctccgttttacgatccgatgattgccaaaatgatcgtcacggcgaatacgagaaaacaagccattgaacaactgaaaaccgcccttggcgaatatcatgtagaagggattaaaaccaacattccgctgcttacaaaaattgcacattcagaagtgtttgaaaagggtgaggcaacaaccggttttttacaaacaatgaacgagggggcgtcaaaatgagcgtcataaaaattcagatggcgggaaacctgtggaaaattcatgtgaagcccggtgatgtcattgaagaaggacaggaagtggccatcttggaatctatgaaaatggaaattccgattatcgctgatgcagcgggtacggtgaaagaagtgaaaaaatcagaaggtgatttcactgatgaaggagaggtcctgattgaacttcaataaaacgggaggtgcagcatgaactgtccggaatatgtccgcatcaatgaagtaggaccgcgtgacggcttgcagaatgaatcggcgtgggtggatacagaagataagattgagtggatcaatatgctgtcaaaaacaggccttccctatatcgaagtgacatcattcgtgcatccgagatggattccggctcttcgtgacagcctggacgtcgcaaaaggcattgccaggtctgaacatacggtctacgcggcgctcgttccgaacctcatcggactggagcatgcggcagaaggcggaatcgatcaggcctgtgtatttttatctgcaagcgaaacccataaccaaaaaaacgtaaacaaaccgattgaccggaccgttcaagagctcaggcgggttattactgaagcaaaagctgaaaaaatggcgacgagagcttatctgtccactgtgttcggctgtccgtacgaacagaacgtgccggtcgaacaagtcatccgcctgtcagacacactgctcgaaatgggtgttgatgaaatatcgctcggcgacacgatcggcgcggcaaaccccttgcaggtcatagccgtgcttgaagcccttttgccgagaattcccgcctcaaaaatcgcactccatttccatgatacaagaggaacggctctagcgaatatcattcccgctcttgatatggggattacatccttcgatacttcctcaggcgggcttggcggctgcccgtacgcccctggatcagcaggcaacgctgccacagaagacgtcatttatatgctcgaacaaatggggattgataccgggacggacatgaataaacttctttatgccgccggctggatcgcggataaaataggcaaagatctgccaagcagaaatctgcaggcattcagaacgaaatgagaaaggagaagccatgggagattgcgtcttgtattccgtctgtcaagaaacgatcggtctggtcacgctgaaccgcccgcatgcggccaactcactgtcatcagaaatgattgatcatttacagcgtgtgattgaagacatcaaaaactcgccatccattcgctgtgtcattctcaccggctccggaagcacattttgcgccggcgctgatttaaaagaaagagctgggatgaatcatgaacaagttaagcaaagcgtcaggcgtatcggtgaaacggctgcatccattgaagctctcccgcagccggtcattgcagcgctgaacggaaccgctgtcggaggaggccttgaactcgctctcgcctgcgatatcagaacagccgtcagccgggcgggcctcggccttcctgaaacagggcttgcaatcattcccggggcgggcggaacgcagagactgccccggcttatcggccccggcgcggcaaaagaattgatctataccggccgaaggctttctgccgaagagggaaaagacatgaagctgatcgagcatgtttgtgaagccgatgaacttatggaaaaagcaaaagcactggccggccgcatcgccgctaatgggccgatcgccgtcagacaagcaaaatccgcgataaacaagggtctggagacagatctcaatacagggctcgaaatcgaacgaaaagcatatgaacaagtcatccctacacttgacagagaagagggcctgcgcgcttttaaagaaaaaagaccccctgaatacaaaggaaaataaaacatggagggactcggatggattacgaaaaagaacggcagacacgcagcaaaacgattgaaaagggaggagccgcgaaatatcatgcaagcaacgaaaagaagggaaaactttttgtaagagacaggctgaagcttttattcgatgacggcatatcggttgaagacgcttttttcgccgagtgcatgtcagacggactgccggctgacggggtcgttaccgggatcggaaccatcggcggcagaaccgtttgtgtgatggcaaacgactcaaccgtaaaggcgggctcgtggggcgcgaaaacggtggaaaaaatcatccgcattcaggagacggcggagaagcttcagtgtccgctcttgtacttagtcgattccgcaggtgcgagaattacggatcaggtcgacatgttcccgggcagaaggggagccggccgcatcttttataatcaagtaaagctgtcgggccgcattccgcaaatctgtttattgttcggtccttccgctgcgggcggcgcttacattccggccttttgcgacattgtcattatggtcgaaggcaatgcatccatgtacttaggttccccgcgcatggcagaaatggtaatcggcgagaaagtatcgcttgaagaaatgggcggcgcccgtatgcattgttctgtatcaggctgcggtgatctcctcgccccgacggaacaggaagcaatcatgatggcgcagacatatctcagctactttccggcaaattatactgaaaaagcgcccgtcaacaaatctaagaacccgaaagcttttgaaaaaccgctctcagatgtcatcccggcacatcaaaacgcaccgttcaacatgatggatttaattgaacgtgtcattgatgaagactcattttttgagattaaaccgttatttgcgcaggaattaataacggggcttgcgagaattcacggacagccggtcggcattatcgccaatcagccgcgtgtcaaaggcggagttttatttctcgattcggcggataaagccgcaaaatttatcgctttgtgcgacgcattccatattccgcttctgtttttagcagacattcccggattcatgatcggaacgaaggttgagcaggcgggcatcatcaggcatggcgcaaaaatgatctccgcaatggcggaagcgactgttccgaagctttccgttatcgtcagaaaagcctacggtgccggattatacgcgatggcggggcctgcttttgaaccggactgctgtttagcgcttccgactgcgcaaattgccgtaatgggtcctgaagcagcggtgaatgcggtctacgcaaacaaaatcagcgagctggcccctgaagaaaggcctgcttttattcaagaaaagcgtgatgaatataaggaagacattaacctttaccggcttgcctctgaaatggtgattgacggcattgttcctgctgattccttgcgggaagaactcaataaacgcctcactgcttacatgtccaaacaactgacattcacacaccggaaacaccccgtatacccggtataaataaaaaaagactgcatagatccggctcgcagccgttcttatgcagtcttttttcacagtcttgatctcattttcttcacaacaaaataaacaacaataaatacgagagccaatataatgatcggagttgtatacattccggcatagctgtctacgtctttccactgtcccccgagctgatacccgagataaacgaaaatgacagaccacggaataatggcaagcgtcgtcaatatgacaaacttggaaagaggcattttcgcaaggccggccgggatggaaatcgcatgtctgacgaccgggataaaccgcgccgagaacacaacgccggcgccgtaacggcgaaaccagttttccgcaacatcaacatgatgctttttcagaagtaagtacttgccgtacttgtccaaaaacggccgtcccccataacgggcgatccagtatataaagcactgcgcgatcgttcccccgatcacaccggcgacaatggcgccgataaagctgatcgtgccttctgacaccatatagcctccgtaagccagaacgatttcactcggaatgatttcgatcattaatccgagcgcaatccctaaatagcccatacttgtcagccaggataatatttcactaataaaattgcccacactgttcacaacctctttatctttttacccaattatatgactgattgacaagcaaaatggttacaaattattttttaacgcacgatttcttcagattctctttttaacacctcttctaaataagctaaaagtttcggtctcatttcttcccgcagaagcccgatctccgtgccggccttaaaacagccgaacttatctcctatatcaaaccggcttccttcaagctcccgcgcgtaaatgcttcgggtgcggcatacttcgcgcagcgcgtctgtcaattggatttcgctgcccgcgcctcttccgatcgtcttcagcgctttaaaaatggcaggggttaatatgtaacggcccaacacggcaatatgagagggcgccttttcaacggccggtttctcaatcagatcctcaacccggtacacatgaccgctctgccgccccgtctgtataataccatatttgctgacatcagcaggatcgacgggctgtacgccgatcgtttctgtgccgtgttggttatagacgtctatgagctgtgaaagagcgggagtgtcagataccataatatcatcacctaatagaacggcaaaaggctcatctccgataaaatgctccgcacacagcaccgcatggcctagtccgagcggttctttctgacggatgtaatgaatattggccaaatcggcaatccgctgcatttccttcagcgtctctgacttgcctttttcctcaagattgatttccaactccgccgaccggtcaaaatgatcttcaatcgagcgtttgtttctccctgtaataatcagtatatcttcaattcctgactctcttgcttcttcgacaatgtactggatggccggtttgtcgacgatcggcagcatttctttcggctgcgcctttgtcgccggcagaaatctcgttcctaaacccgctgcggggatgaccgcttttctcactttttttctcattcatcttcactcctgatcctgtatgtttttcagcgaatctccaaatacccagattcggtttccgataaaattcatcatcattccgccgatagtggcggcgagcttactcaccaaaagcgaacagccgcctttttgaaacgcgtacagcagcaaaaaggtgattcccgacgctgcaagattaatgatgagaaagcgcacgatctctttcccgtcagccttgtgttttacacgaaacgtccacttccggttccacacatagctgttgatgatccctgccgaataggagcagatctgcgccggcagataggggacaaggcaagcggtgagaagaaagaagacaccaaaatcgatcagcgtattgccggcgcccacggtgcaaaaacggcctgctgtctttactttttctttcagcataacggcatccggttttgacctcccttcataagtaagatgcggatcgctgtcctatttgttgatatggattactttagcggacagtgttgaataaacaattactaaaatatgaacaaaacatgaaaacgtaatgaggctttgtaaaacccattaagttaacagttttatagtttaggttgacatattacgtgcaagacactaatattctgtattagtgttaaccttttattattttggttaacattaaatttcgaaataaaagaaaggagggaaatttcatgcgggaagagacctattacagcgtcagaatgagagcttcccgaaacgccccccatgagcagggcggaaaacacatttccggcggagaacggctcatcacttacagcggtttacaggaagcggtagatggcttattacataaaggcttctcacactcaagagggatacctgattttatgcagattcagcttgaaagcgttcatgaaccgatcgaaacgatccgccctttgccggttgccctccatcaaacagacaccccggaaaaaggacaagcaatcgcccgcaagcttctgcaaaaggcggggattcctccgcacatgatcgagaaagcgtacgaaaacattgcggaatatgcagaagcaagaggagcggtcctgtttgatatccgggcaggaaaacgcattgactgcagagggaatagaggtgtgcgggtatcccgagtggattggccgtcacatgattttcaaaaatgggcttttactcacaacatgccggaaaattcacgaataaaggaagcacatgccatcgcggcaaaagtttgcgcacatccgggaattattgccgaattgtgctggtcagatgaccctgattacataacaggctacgttgccgcaaagaagctgggatatcagcggattgccaagatgaagaatgccggagatgaaagcggatgccgggttttctttactgatggctccatagatgcggagagctgtatccattttttagagaagcagcctgtattcatacagcgggaggagaacttatgaaacaatcaatgattgaaaaaagcaaacagcatctttggctgcctttcacacaaatgaaagattacgatgaagatccgttcatcattgaaagcggaaacgggatcatgctgaaagacatcagcggcaaagaatattatgacggcttttcttcagtatggctcaatgtacacggccaccgcaaaaaagaaatggatgaagcgattcaaaaacagcttgaaaaaatcgctcattcgactttgctgggtatgacgaacgttcccgcaacagaacttgccgagatgctgacgggcatcacaccggaaaagctgacgcgcgttttttactccgacagcggagcggaagcaatggaaatcgctctgaaaatggcctttcaatactggaaaaacgtagggagacctaagaagcagacgtttatttcgatgcagaacggctatcacggcgatacaatcggagccgtcagcgtcggctccattgaactcttccaccatgtgtacggcccgctgatgtttgaaagctacaaagccccgattccttatgtatacagatctgaaagcggtgaccccgtacagtgccgggatgaatgccttcacgcgctcgaacagctgcttgcaaagcaccacgaagagattgccgcacttacgattgaatcgatggtgcaaggcgcatccgggatgatcgtcatgcctgaaggctttctggcaggcgtacgaaagctgtgtacggcatatgatgtgttaatgatcgttgacgaagtggcgacggggttcggccgcaccggaaaaatgtttgcctgtgagcatgaaaacgtccagccggacttgatggcggcagggaaaggcattacgggaggctatttgccgatcgctgtgacgtttgccacagaagccatttatgaagccttctacgatgactacgacaaaatgaaaacatttttccacggccattcctatacaggaaatcagcttggctgtgccgcggcaattgaaaatctgcgtttattcgaatcagagcgcatcgttgaacgagtcgccgaaaaatcaaaaacggctgcgaaatttcttcatgatctgaagctgcttcctcatgtcggcgatgtccgccagctcggtttgatgtgcggcatagagcttgtgcaggataaggggacaaaacagccttatccacctgaaaagcggatgggatacaaggtgtccttgaaaatgagagagctgggtatgctgacacggccgctcggtgacgtcatcgcctttcttccgccgctcgccagcacaaccgaccagttacaagccatgatttccattatgaaagaagcgatagccgaggtgaccggccgtggattttgacggatggctcctcggaaggctcgatgcggtgaaaagagacgggctgtatcggacgctgcgaacacaggaaaccgctcttaaaaccaaggggcaaaagcggcagacctgggcgtccaatgactatttaggtctgtcaaaagatgaacggctgatcacagccgcgcaaacagcgctgagccggttcggagcgggaagcggcggctcacggttaacgacaggaaatactgtgtggcacgaaaaacttgagcaaaaaatcgcggactttaaacagacggaagcggctttattattttcaagcggttacttggcaaatatcggcgtgcttgcctcactgcctcaaaaaggcgatgtcattttaagcgatcaactgaaccatgcgagcattgttgacggctgccgtttatcaaaagcggaaaccatcgtgtaccgccatattgatatggctgatcttgaaaaaaaacttgcctccgtccagactcggaaccgccgctttatcgtcacagacggcgttttcagcatggacggcaccatcgcgcctcttgaccgaataatgccgcttgcaaagcagtaccaggcatttgtgatagcagatgacgcgcatgcaaccggtgtactcggggaaaacggcggaggaaccagtgactatttcggtgtttgtcctgatgttgtcatcggcacattaagcaaagctgtaggaacggaaggcggttttgccgcgggatccaacatttttattgattttttgctgaatcaggcgcggacgtttatttttcagacggccctcccgccgtcaatttgtgcggcttcgcatacggcatttgacctcatatcagatatgcacgatacgcgccgtgagctgcagtcgtctgtcaaaaagataaaaacgcgtctggccgatatgggctttactgtaagaggcggagatacaccgattatccccgttatcatcggtgatgcaaaaacagcggtttcagccgctgcgctgcttgagaaaaagggaatctgcgccccggccatccgcccgcccgccgttccggaaggcgaaagcagaatcaggctgaccgttacggcggatcgcagcttacaggacatagacgagctgacagaagcatttgattccattagaaaagagctgaatataaacaaatgagaagtttttttgtcacaggaacagataccggcgtcggaaaaaccatcgtttcttgcggacttgccgcggcattcaggcagaaacaggcggatatcggagtgtttaaaccgtttttaagcggcgtgccgcggactcatccggaaagtgacacctcgctgttgaaaaacatgtcacaaaccgcactgtctcatgaagaaatcacgccatttgaatggaaagagccgcttgcgccgtacacggccgccatgcttgaggggaaatccgtgagcatggatgaagtcatggcccactggagtaagatcaaaaatcgtcatgagtgtttcatcgtcgagggggcaggcggcatttccgttccgcttggtgaaaattacttagtcagtgatttgataaaagccttggaattaccggcagtgattgtcgccaggcctgatctcggaaccatcaaccacacatatttaaccgttgaatatgcgaaaaacatgggaatagaggttctcggtattattatcaacggcgtaaagagccggccggggctggacgagaagacaaacccgagcatgattgaaacattatgcaaagttccgattttgggaatcacaccgaagctggatcacgtttcaccggaaaacattcaacacatgattgagaaacatatagatgtttcctctttcatgaatctgacacaaatggggagataaacatgaatcaatggatggatcttgcagagagagttctggacggggcggaagtaacgaatcaagaagcgctggccattttaaattgtcctgatgaggatcttttattgctgatgcatgccgcttttcatatcagaaaacgattttacggaaaaaaagtaaagctgaatatgattatgaatgcaaaatcaggcctgtgtccggaaaattgcgggtactgttcacaatcttcaatatcaaaagcgccgatcgagtcttatcggatggtggataagcatatattgcttaagggggcaaaacgcgcccatgacttgaatatagggacatactgcatcgtcgccagcgggcggggaccgttaaacagagaagtagatcaagttgttgatgctgtcaaagaaattaaagaaacgtacggtttaaaaatctgcgcatgcctcggtctgctgaagccggaacaggcagagcgcctgaaacaggcaggagtagaccggtacaatcataacatcaatacatcacaaaggaatcactcaaacattacgacttcccacacgtatgacgacagggtcaatacagtggaaacggcgaaacaatcggggatgtcgccttgttcgggtgtcatcgtcggcatgaaagaaacgaaacaggacgtcattgatatggcgaacagcttaaaagcgcttgatgccgacagcatcccggttaattttctgcatgcgattgacggaactccgttagaaggggtaagcgaattacatccggtgtattgcctgaaagtgctcgccttgttccgttttatcaatccgtcaaaagaaatccgtatctcaggaggccgggaagtcaaccttcgttcgctgcagccgctgggactttacgccgcaaattcgattttcgtcggagattacttaacgacagcagggcagcatgaaacagaggatcatcaaatgctccatgatttagggtttgaagtcgaatccgttgaagaaatgaaagccggcctgcaatccgcctgcaatacggaggtataagatgacggcgggcttatcgactgcacatccgtccctccatgcggattcggatttttggaatgacccttacccgttttatgaaaaactgcgtgccattgatcctgtttataaaggaaccgtattaaaacatccgggctggtatgtcaccgggtataaagaagcggcagcgattttgaaagacacccggtttaaaaaccgcgtcccttttccggaagcttcaacgaaatatcaaaatctatcgcatatccagcacgatatgctgttatttaaaaatcaatcagaccataagcggatgcggatgcttataggtaaagaatttaccgcaaagacggcggaatcacttcgcccctgtataaaagaaacggttcatgacttgttggatcaaatccaaaacaaaaaaaacgcagaccttgtttcagagtttgcctttccattggcaagcctcatcattgcggagatactcggagtgccgaaagaggagagatatcaattcagacaatggacggcagacgtcattcaggccattgatcttacccggtcaagaaagatgttagtcagagcaagcgacaccgcaggcaggctgactgcttatttcagagatttgattcacgagcggaaagcacatcctcaggaagacttaatcagcaggtttattatgggggaacagctttcaaaagacgaagtgctcgcgacatgtatcttacttgtcatagccggacacgagacgacggtaaacctcatgagcaacggtgtgtttactttattgaaacaccctgaacagcttagcgcactgagagaaaacccctcgcttattgaaactgctgtcgaggaatgtctgcgctacgacagccccgcgcagctgacggcacgcaccgcttcagaagactgtgaaataaatgggaagaccataaaaaaaggagagcaggtatatatccttttaggggcagccaatcgcgatccaagcatattcgatcagcctcataaaatggacatccaaagaaaaccgaatccgcatcttgcattcggaaagaacgcccatttttgcataggctcctcattagcgcgcatcgaagcacaaattgcaattctcacactgtttgagcggatgcctaagcttcggctggccgcacaccgccttgaataccgcaagctcattggttttaggtcgctcaaagagcttccggttgtccttggctgaatgaccatgcaggagggccggattttatcggttcctcttgcaggaaataaatgaaagaaaaaagaatacatatttataaagcaaaaatcctctctgatccatctcactatccctaaaaaaactcgctgctcagccattcaatatcatgcagcaagaatctccttttctttcgccaaaacggaaaattcaccatgatgcacattttttcagcctcagaaacggtgcaaaatcggcatgttttttgctttattttcttgattcatgtaagcgcttactaatattgagcagaaaagagggggatttgtggacattgttattattttattggcattaggcatgctgatgtttgcggcttaccggggcttttcagtcattttattcgctccgatttgtgcgctgtttgccgtgcttcttacagatccaagcttcgtacttcctttcttctcgaatatatttatggagaagatggtaggatttattaagctgtattttcccgtatttcttttaggggccgtttttggcaaggttgttgaaatatccgggctcgccgagtcgattgcaaaaacaatcgtcagacttgtgggagcaaaaagagccattctcgccatcgtcttaatgggtgcgattttaacgtacagcggcgtcagtctcttcgtagcggtgtttgccatttatccgtttgctaaaaacctatttattaaagctgatattcccaagcgtctgatacccggtacgattgcattgggcgcgtttacttttacaatggatgcgcttcccggcacaccgcaaattcaaaatgtcattccgacagctttttttaaaacaaacatttatgccgctccctggctcggactgattggcgcagcatttgtgcttacggccggaatgatttatttagaatcccggcgcaaaaaagcggccaatgccggagaaggctatgctggatttcaatctgaagtttccgctgcagaggattcctcaagtctggctaatgaaaaacatacgcctgttttaccgcaggaggcagaacccagccccgcgcggcaagtgctcgcctttgttccgcttatccttgtggggatcatgaacaaatgcttcacgatgtggctcccgcattggtaccctgacggatttgattttgcgcagctcggtttaaaagcgttcgggaagattgacctttcctccgtcactgcgatctggtcagtagaactcgcactgctcatcggaatcatgacaacgattttgttcgattggaaaaaagtgctcttcaatttgaaagaaggactgaatgagggcatcgggggtgccttgctggcgtcgatgaatacaggagccgaatacggatttggcggcatcattgcggcgcttcccggctttaaaatggtcagcagcggcatatcgcagacgtttactgatccgctcgtcaacggagcggtgacgaccactgcgcttgccgggattacaggatcggcatcaggaggaatgggcatcgctttaagcacgatgtcagcagcgtatacagaagcaatcaatacattccacatcccgccggaggtcatgcaccgggtgatttcgatggcctccggcgggatggacactcttccgcataatggcgccgtcattacactgctcgcggtcaccgggttgacccaccgccaatcctacaaggatatctttgccattaccgtcattaaaacagccgctgtgtttgtcattatcgccatttacagtctgacgggccttgtgtagccaaaacagaaaggggaaacgaatatgggaaaaggaaaagtgatggactcttatcaagatgctgctgcactgatcaaggacggagacaccctcatcgcaggaggcttcggcctgtgcggcattccggaacaattaatactcgcgatcagggacagcggcgtgaaaaacttgaccgttgtcagtaataactgcggtgttgatgattgggggttaggcctcttgcttgcaaaccggcagatcaaaaaaatggtcgcatcctatgtcggagaaaacaaaacctttgaacggcagtttttaagcggggagctggaagtcgaattggtgccccaaggaacgctcgcagaaagaattcgcgcgggaggggcgggcattccggcgttttatacacctgcgggcgtcggaacatcagtagccgagggaaaagaacataagacatttgacggacgcacctatcttctggagaaagggattacagggaacgccgccatcgtaaaggcctggaaagccgatcctctgggcaacctgatgttcagaaagacggcgagaaatttcaatccgctcgctgcaatggcaggcaaagtgacgattgcagaggctgaagaaatcgtcgatgccggagagcttgatcccgatcaaattcatacgccgggtatttttgtgcagcacgttctgcttggcgggattcatgaaaaacggattgaacgccgcaccgtccggcaagcatgataaaggaggctgacagaatgagagatagcagaaaacgaatgatcgaacgggctgtaaaggaaataaaggacggaatgaatgtgaacttggggatagggatgccgacgcttgtagccaatgagataccgaatgattataacgtcctgcttcagtctgaaaacggcttgctcggaatcgggccttatccggcggatggaacggaggatcccgatctgatcaatgcgggaaaagaaaccattaccgaggtaaagggagcctcgtattttgacagtgccgaatccttcgccatgattcgcggcggccacattgatgtagcgatcctcggcgggatggaagtgtccgaacggggagatttggcgaactggatgatccccggaaaaatgatcaaaggaatgggcggcgccatggacctggtccacggagcaaaacggattattgtcattatggagcatgttaataaatatggggaatctaaagtgagaacggaatgtacgctgcctttaaccggcaggcaggtggtcgatcggctgatcacagatttggctgtattcgattttcatgatggccgtatgacgctcaccgaactgcaggaaggtgtaacaatggaggaggtctttgagaaaacagaaggtcattttactgtcagccagtcgttaaaaaacggggtcagaccaaaatgaggaggtgccgtcatgcattcattgcttattgaaaaaacagccgttgtaacaggagcagccggaggaatcgggcttgaaattgcaagagaattcgcccgtgaaggagcagccgtcatcatctctgatgtaaacgaacaagcggggaaagaagcggcggcaagactgaaagaagaaggctgtgaagcagtcagcatcacatgcgatgtaacaaatgaaagacaagtggccgacatgctgcagacggtcgagaaacaattcggacgcctcgatatccttgtgaataatgcgggcattcagcatgtcgcgcccatcgaggaatttcccaccgaacagtttgaacggctcattcgtgtcatgctgactgcgccatttatcgcaatgaagcatacattccccattatgaaaaaacagcaattcgggcgaatcattaatatggcgtctgtcaacgggctgatcggttttcacgggaaagcggcatataacagcgccaagcacggcgtcatcggtttaacgaaagtcggcgcacttgaaggcgcggctgaaggcattaccgtcaatgcgctttgtccgggatatgtggacactcagcttgtccgcaatcagttaaaggacatttccgcaacaaggaatgtaccgtacgagcgggtgcttgaggacgtcatctttccgctcgttccccaaaaacggctgctgtcagtgaaggaaatcgctgattacgctgtatttttggccagcgacaaagcaaaaggggttacaggtcaggccgtagtcatggatggcgggtataccgctcaatagttcttatattttttaaaaaacagccgctctgaacggctgtttttttatgcctgaaaaatcttgttcactcaataggccgatttactgcgccaaccggtatccgggctgggtcattcacatgttctgcggcgtattttgtccttgcagatttttctcatccagatccatttctgcaccgcatttataatcaagcgccatcagtttacaatccttcacagatatacaaatgaatttttacaataaacataaaatatgtaatttctgacacaataatgccaatagccctaaaacatatgaaacatgaagagcgcggcctaagtgaagaagagccggtaacaagctccactccggcttttcatcatctctctttaagacagattttcggtgaaaccccatgttttattttatgaataaatatatctaattcgtttgtaaaatcgaacaataactcctccgaaagtattctatacacatttgttataatcatgctaggatgttatataaagggataatttgtaggatattgtatttctgttcaatatgatcggaggaatctcatgaacaatcttgcctttttatttcctggacaagggtctcaatttgtaggaatgggcaaacaattttggaatgattttgtgctcgcaaagagattgtttgaagaagcgagcgatgcgatctccttggatgtaaaaaaactgtgttttaacggagatatgaatgaattgacaaagacaatgaacgcgcagcccgctattttaacggtcagtgttattgcttttcaagtgtatatgcaggaaataggggtgaagccccgcttcctggcaggccatagcttaggcgaatattcagcgcttgtctgtgccggcgccctttcttttcaggatgccgttacacttgtaaggcagcggggaattcttatgcagaatgcggatcctcagcagcaggggacgatggccgccgtgactcacctctctcttcaaacgttgcaggaaatatgttcgaaagtgtcgacggaagactttccggcaggagtagcctgcatgaattcagaacagcagcatgtggtttccggacaccggcaagctgtggaacgtgtcatcaagatggcggaggaaaagggagcggcatacacttatttgaatgtcagtgcgccttttcacagttcgctgatacgatcagcatctgaacaattccagactgtattacaccggtattccttccgggatgccgcatggccgatcatttcaaatgtcaccgcacgcccttacagcagcggaaattcaatcagcgaacatctcgagcagcacatgacgatgccggtaagatggacggaatcgatgcattacttgcttttacacggagtcacagaagtcatcgaaatgggtccgaacaatgtcttagccggtctgctgagaaaaacaacgaatcacattgtaccttatcccttaggacagacatctgatgttcacttgctttccaattcagcagaaagaaagaaacatattgtccgtttacgcaaaaaacaactgaataaattgatgattcaatccgtcattgcgcgaaattacaacaaggattcagcggcttattccaatatgacgacggcattatttacgcaaatccaagagctgaaagagagaatggaaagacatgaaaatgagctctcagaacaagagctcgaacattcgatccatttatgcaaattaatttgcgaggctaaacagcttccggattgggaagaattgcggattttaaaataaagcgcccaggaggggacctatgtataccagtcaattccaaaccttagtagatgtcattcgggaaagaagcaatatctctgaccgcgggatccgttttatcgaatccgataaaaacgagacggttgtctcttatcgccaattgtttgaagaggcgcaaggatatcttggctatttacagcatatcggcattcagccgaagcaggaaattgtatttcaaatccaagaaaacaaatcatttgtcgttgctttttgggcttgtatattaggaggaatgatcccggtgccggtcagtatcggagaagatgatgaccataagctgaaggtctggcgcatttggaacatattaaatcacccgtttctgattgcctctgaaaaagtattggacaaaataaagaaatacgctgcagaacacgatttacaggatttccatcatcaattaaacgaaaaatctgacatcattcaagatcaaacctacgattaccccgcttcgttttatgaacctggtgcggatgaactcgcctttatccaattttcttcaggatcgacaggagatccaaaaggagtcatgttaacgcatcacaacttaatacataacacgtgcgccattgggaatgccctagccgttcattcgagagactctttcttatcatggatgcctttaacgcatgatatggggctcatcgcctgccaccttgttcccttcataaccggaatcaatcaaaatctgatgcctacagaattatttattcgcagacctattctttggatgaaaaaagctcatgaacataaagccagtattctatcctctcctaatttcggatacaactacttccttaaatttctgaaaaacgaaccagactgggatttatcccacatcaaggtcatcgcaaacggtgcagaaccgatattgccggagctctgtgacgaatttttgaaaagatgcgcagcattcaatctgaaaagatccgccattttgaatgtttacggtttagcggaagcttcggtcggcgcagcattctctaaattaggtaaagaattcgttcccgtttatttgcatcgcgatcatttaaatctcggtgaaagagctgtaaacgtcagcaaagaggatcaaaattgcgcttcattcgtcgaagtgggacgacctattgactattgtcagcttcggatctccgatgaagcaaatgaaagagtagaagacggaatcatcggccatatccagatcaaaggagacaatgtgactcaagggtattataacaaccccgagagtacggaaaaagcgctgacttctgacggctgggtaaaaacgggagacctcggattcattagtgaaagtggtaacttagtcgtaacgggaagagaaaaggacattattttcgtgaacggaaaaaatatctacccgcacgatattgaacgggtcgcgattgaaatggaagaggttgacttaggaagggttgccgcctgcggtgtatatgatcaaaagacacaaagcggagaaatcgtgctctttgttgtttacaaaaaatcacctgaaaaattcgcaccgcttgtcaaagagataaaaaagcatttgctcaagcggggcggctggagcataaaagatgtccttccgatccgaaaactccctaaaacaaccagcggaaaggttaaacgctacgaacttgccagacagtatgaggcagggaatttttcaacagagtctgccgccatcaatgaatatttggagagcagcccggaaacgtccggacagactcccattcatgaaattgaaacggaattactgtctatcttttccgatgtgctcaatgggaaaaaggttcacctcgctgacagttattttgatatgggagcaaattcattacagttatcgcagattgccgagcgcatagaacagaaattcggacgcgagcttgccgtttcagatctctttacgtatccttctatcactgatttagcggcgtatctgtctgaaagccgggctgaaatcaagcaggacgtggcagcgaaaccaagccatgtgacaccgaaagatatcgccattatcgggatgtcgctcaatgtccctggagcatcaactaaaaatgatttttggaatctgcttgaaaaaggtgagcacagcattcgagaataccctgcatcccggctgaaagatgcggcggattatttaaagtccatccaaagcgaaatcaatgagaatcagtttgtgaagggcggctatttagatgaaatcgaccgctttgatttctcgttcttcggtttagctcctaaaacggctcagtttatggaccctaaccaaagactgtttttgcagtctgcatggcatgcgattgaagatgcgggctatgccggcggcagcatgaacgggagccgtgtcggggtatatgcagggtactcgaaggtgggctacgattatgaacgtctcctttctgcgaattatccggaggagcttcatcaatatatcgtgggcaatctcccttccgtgttagccagccgaatcgcttatttcttaaatttaaaagggccggcggtcacagtcgatacggcgtgctcctcatcgcttgccgccgttcatatggcatgtaaatctttaatatccggcgattgtgaaatggctcttgccggcggtatccggacatcgctcttgccgatctgtatcggacttgatatggaatcttcggacgggtacacgaaaacgttcagcaaagattcagacggtactggcacaggtgaaggcgcggccgcagtcctgctgaaacctctgcaggatgctgttcgcgacggagaccatatttacggcgtaatcaagggaagcgcgttgaatcaagacggaacaaccgccgggattacagcaccgaatccggcagctcagactgaggtcattgagacggcctggaaagacgcgggcattgcccctgaaacactgtctttcatcgaagcgcatggcaccggaacgaagctcggcgatccggttgaatttaacgggctttgtaaagcgtttgaaaagtatacggcaaaaaaacaattttgtgcgattggttctgttaaatcgaacatcggtcatttgtttgaagcggcaggcatcgtcgggctgatcaaatctgtcctcatgctgaatcacaagaaaaatccgccgttagtgcactttaatgaacctaatccgctcattcattttcactcttcaccattttacgtaaaccaggaagctgcagcgttcccatccggtgatgagccgctgcgaggcggagtcagctcatttggctttagcggaacgaacgctcatgtggtattggaagaatatatttctcaaagtgagtatgcgcccgaggatgaacatgggccgcacctatttgttttatccgctcatactgaaaaatcactctatgaactcgcacagcagtaccggcaatatgtatcggatgacagccaagcttcattaaagtccatttgctatacagccagtacgggcagggctcatttggatcatggcattgccatgattgtatccggtaaacaagaactatcggataagctgacccgcctgattcagggagacagaaaccttcccggtgtatacatcggctacaagaatatgaaggaaatgctgcccgctcataaagaagagctgaataaacaagcagccgcactgattaagcagcgtttacgtacgcaagatgaacggatcacatggctgcatcgcgccgccgaattatttgtgcaaggagccgttatcgattggcgcgcgctttattcaggtgaaactgtacaaaagacgccattgcccttgtatccgtttgaacggagccgatgctgggctgaagctgaccaattgcgcttaaacgaggacgaaaagagaggagaagcggcattgaatatcaatcaatcgaagtcgcatattgaatccttcctgaaaactgtaatcagcaatacttcggggatcagagcggaggaactcgatctgaatgctcattttatcggactcggaatggattctatcatgctgtcacaggtcaaaaaagccatcgcggacgaatttggggcagacatcccgatggatcgtttttttgatacgatgaacaaccttcaaagtgtcatagattacttggctgagaccgttccatcgtcctttgcatccgctccgcctcaagagaatgttccggcgcaggaaatgcaggtcatttcagaagcacagtctgaatcggatcgcagagaaggtcatcaagagcatatgctcgaaaaaataatcgcttctcagaatcaattaattcaggataccttgcaagctcaattaaatagctttaatttgttgagaaacagcggacatcattccgatgagaaagaatacgctaaagcgcaagagagatcaattccttctgtccagcaggggcctccggccgtcactgcagaaaagaaagcggctcaagaagcgaaaccctatgttcctttccagcctcagaacctgcatgaacagggacactataccgcacggcaaaaacaatacttagaagatttcatcaagaaatacgcagataaaacgaaaggttccaaacaatatacggacaacacccgatttgctcatgcaaacaaccgcaacttgtccagcttccgttcatattggaaggaaatcgtatacccgattatcgccgaacgttctgacggttctaaaatgtgggatattgacggaaatgaatatatcgatgtcaccatgggattcggggttaaccttttcgggcatcatccttcctttattacacaggttatcgatgattcagcccgttcatcattgcctccgctcggaccgatgtcagatgtcgccggtgaagttgccgaccggatccgcacatgtaccggggtagaaagggtcgctttctataattccggaacagaggccgtcatggttgccctgcgtttggcgcgggcggcaacaggaagaaagaaagtggtggcgttctcgggctcttatcacggcacgtttgacggcgtattaggggttgccggcacaaaaggcggagctgcgtctgcgaatccgctggctcctggtatactgcagagctttatggatgatttgattattttacattacaacaatcccgattcgctggacgtgatccgcagtcttggtgatgaattggcagccgtactggtggaaccggtacaaagccgcagaccggatttgcagccgcgggcatttttgaaagaattgcgggcgatcacgcagcaatccggaacagctctgattatggatgaaattattaccggatttcggatcggtctcggcggcgcacaggaatggttcggcattcaggctgatttagtgacctacggaaaaatcatcggcggcggacagccgttaggggtagttgccggaaaagctgagttcatgaatgcgatcgacgggggcacctggcagtatggggatgattcctacccgcaagacgaggcgaaacgcacgtttgtggccggaaccttcaatactcatccgcttaccatgagaatgtcattagccgtgcttcgtcatttacaaaccgagggagaacatctgtatgagcagcttaatcaaaaaacagcctacttggtggatgagctgaatcgctgcttcgaacaagcgcaagtgcctatccgcatggttcgattcggttctttattccggtttgtctcatcgcttgataatgacttgttcttttaccatctcaactataaaggtgtctatgtgtgggaaggacgcaactgcttcttgtctgcggcgcataccgctgatgatatagaaaagattattcaagcggtgaaagacacggtggaggatcttcgccgaggcggatttattccggaaggcccggactcccctgatggcggaggccgtaaaaagtccgggacgcgcgagctttcacctgaacaaaagcagttggttatggcatcccattacgggaatgaagcgtccgccgctttaaaccagtccattatgctgaaagtggagggcgaactgcagcatacaccattaaaacaagccgttcggcatatcgttggccgtcatgaagctttacgtacagtgattcatcccgatgacgaggtacagcaagtgcaggaacggatgaatatagaaataccagtcattgattttaccgttcacccgcatgaacatcgggagtcggaaattcaaaaatggctgacagaagatgccaagcggccgttccatttccatgaacaaaagcctttgtttagaatccatgtgcttacatcggctcacaatgaacatctgattgtgctcacgttccatcatatcattgccgatggatggtcaatcgccgtatttgttcaagaactggagagcaactacgcggcaattgtacaaggaaaaccgatttcaccgaaagaggcagatgtttcgtttcgccaatacttagactggcagcaggcacagattgacagcggccattatgaagaaggggtccgttattggcggcgtcatttctctgaaccgattcagcagccaattctgccgagcacaggttctgtccgttatccgaacgggtatgagggagaccggtgtaccgtcaggcttggacggccattgagcgaggctttaaggtcattaagcattcagatgaaaaatagcgtatttgtaacaatgctgggtgcatttcatctttttctgcaccggcttaccaaacagtcaggccttgtgatcgggatccccgcagcaggtcaatcgcatataaaacagcatgatctgattggaaattgcgtcaatatgattccggtgaagaacacgtctacttcagaaagcactttaaccggttatcttggcagtatgaaagaaagcgtgaatcttgcaatgcggcaccaagccgtcccgatgacactggtggccagagagcttccgcacgatcaagtgccggatatgcgtattatctttaatttagacaggccttttcgaaagctgcatttcggaaaggcggaagcggagcccgttgcatacccggtaaaatgcaccctgtacgatttatttcttaacataacagacgcgcatcaagaatatgttcttgatttcgactttaatacgaacgtcatcagtccggaaatcatgaaaaagtggggagcgggttttacaaatttgctgcaaaaaatggttgagggggattcaatccctcttgacgccatgatgatgttttccgatgaagaacagcacgatttacaaaaactgtatgccgaacaccagaagcgggtctcttcaataggaagcaatacagcaaatttcactgaagcctacgaggcgccgataaatgaaacggaacggcagctggcgcggatttgggaggaacttttcggccttgaacgggtcggcagatcagatcgctttctggctctgggaggaaactcgctccaggcgacgcttatgctttccaaagttcagaagacatttcatcaaaaggtttccatcggacaatttttcaatcaccagactgttaaggaattagcacatttcattcagaacgaaacaaaagtcgtgcacctcccgatgaaggctgccgagaaaaaagcgtattacccgacatcgccggcgcagcaaagagtatatttcctgcaccaactggaaccggatcagctggcgcaaaatatgttcggccaaatatcaataacagggaagtacgatgagcaagccctgatctcatctcttcaacaagtgatgcagcggcacgaagcgtttcgcacgtatttcgacattatagatgacgatatcgttcagaaacttgaaaacgaagttgattttaacgttcatgtccggacaatgagccgggacgaatttgatgcctattcagaccggtttgtaaaaccgttccgcctggaccaagctccgttagttcgtgcggagctgatcaagattgaaaacgagcaggccgaactgctcatcgatatgcatcatatcatttcggatggttattccgtcaacatccttacaaatgaattgctggctttatatcatcagaaaccattaccggacattgaatttgaatataaagatttcgcagaatggcaaaaccaacggctgaatgaggatgccatgaagcggcaggagacatattggctggaacaatttcaagacgaaattcccatccttgacctgccgacagacggttcaaaagtggcagaacgctcttctgagggacagcgagtgacatgctccttacagccggatgtcatccgttcgcttcaagatttggcgcaaaaggcggaaaccactctctatacagtgctcctggccgcctataatgtgctgcttcataaatataccggacaagaagacattgtcgtaggcacgcctgcttcaggaagaaatcatccggatatcgaaaaaatcatcggtattttcatacaaaccatcggaatccggacgaagccgcacgccaatagaacgtttacggattatctggaagaagtaaagcggcagacgcttgacgctttcgaaaaccaagactatccattcgaccggcttgtggagaaattaaatgtacagcgggaaacaaccggaaagtctctgtttaacacgatgtttgtgtttcaaaacattgaatttcatgaaatccggcacaatgaatgtacatttaaagtgaaagaacgaaatccaggggtctctttgtatgatttgatgctcacgatcgaagatgccggtcaacagatagagatgcattttgattataaaccgggacgattcacaaaagacaccattgaacagatcaccagacactataccggcattttaaacagtcttgttgagcagccggagatgacattgtcttccgttcctatgctgtctgaaaccgaacggcatcaactgctgacggagtgtaacggcacaaagacgccgtatccgcataacgaaacagtaacccgatggtttgaaatgcaggcggaacagagtcccgatcaggaagccgttatttttggcaatgagcggtatacgtacagacagctcaatgaacgggcgaaccgattggcgcggacgttacggacaaaaggcgtacaagcggatcaattcgttgccatcatctctccgcatcgcatcgagttgattgttggtattttggctgttctgaaatcaggcggcgcatacgtgcctattgatcctgaatatccggaagatcggatccaatatatgctgagagattcaagggcggaggttgtgttgacacagcgcagcctgctggatcaattaccgtatgatggtgacgttgtgcttttggatgaggaaaactcataccatgaggatcactcgaatcttgaatcggacagcgatgcgcatgatttggcctacatgatctatacgtcaggttccacgggaaatccaaaaggtgtcctcattgagcatcagggactggctgattatatttggtgggcgaaagaggtctatgtaagaggtgagaaaaccaacttcccattatactcttccatctctttcgatctgactgtgacctcgatatttacgccgctggttacgggaaataccatcattgtctttgacggcgaagacaaaagcgctgtgctttctgagattatgcgggactcaagaatagacatgatcaagttgaccccggcacatctgcacgtcatcaaggagatgaatatcgctggcggcaccgcaatacggaaaatgattgtcggcggagaaaatttaagcacccgtctggccaaaagtgtcagcgagcagtttaaaggccggctggacattttcaatgaatacggaccgacggaagctgtcgtcggatgtatgatttatcacttcgacgcagaacgggacaagcgggaatttgtaccgatcggcactccggctgccaacacggatatttatgtggccgatgcaagcagaaatctggttccgatcggggtaatcggcgaaatatatatcagcggaccgggtgttgccagagggtattggaaccgtccggatttaacggcagagaaatttgttgaaaacccgtatgtcccgggagcgaagatgtacaaatcaggggatttggctaagcggttgaaggacggaaatcttgtatatatcgggcgcattgatgaacaagtcaaaatcaggggacaccgaatcgagcttggtgaaattgaagcagcaatgcataacgcggaagcggtgcaaaaagccgcggttacagtgaaagaagaagaagacggcttaaaacaattatgcgcgtattacgtaagcgacaagcctatagcggctgcgcagcttaggaaacaattgtcatcggagcttccggactacatggttccgacctattttgtccatctggagcatatgccgttaacgtccaacgggaaaataaaccgtaaggcactgcctgcaccagaagcgagtctgcagcagacagctgaatatgttccgccgggtaatgagacggagtccaaactgactgatttatggaaggaagtgctcggaataagccatgcggggatcaaacataatttctttgatctcggaggcaactccatccgagcggctgccttagccgccagaattcacaaagagctggatgtgaatctgtctctcaaagacatattcaagtttcctaccattgaacaattggctgacaaggcgttacacatggacaaaaaccgatatgtaccgattccggctgcaaaggaaatgccatattatccggtttcttcagctcagaggcgtatgtatttgttaagtcacacagaaggcggcgagctgacttacaatatgacgggtgccatgaatgtggaagggacgatcgatcccgaacggttaaacgccgctttccgaaaattaatcgcgcgtcatgaagcgttgcggaccagctttgatttatatgaaggcgagccggcacagcgtattcatcagaacgtcgactttacgatagaacggattcaagcaagcgaagaagaagcggaagaccgtgtgcttgatttcatcaaagcgtttgacttagccaaaccgccgctgatgcgggccggactgattgaaattgaacctgcgcggcacgtgcttgtggttgatatgcatcatatcatttctgacggcgtgtccgtcaatattctgatgaaagatttaagccgaatctacgaggggaacgaaccggacccgctctctattcaatataaagactttgcagtttggcagcaatcggacattcagaaacggaacatcaagagccaggaagcgtattggctggatcagtttcacggtgatattcctgtactggatatgcctgcggattatgagagacctgccatacgcgattacgaaggcgaatcatttgaatttcttatacccgaacacttgaaacagtgtttaagccaaatggaagaagacacaggagcaacactgtatatgattttattggcggcctatacgattcttttatccaagtacagcggacaagaagatattatcgtaggaacgccatctgccgggcggactcatttggatgtagagccggtcgtgggaatgttcgtcaatacgttagtcattcgcaatcacccggcgggccgtaaaacatttgatgcctacttaaacgaagtaaaagaaaacatgctgaacgcttataaaaatcaagactatccgttggaagaattaattcagcatctgcatcttccaaaagattcaagccgcaatcctttattcgatacgatgtttgtgctgcaaaatctcgatcatgctgaattgacttttgattctcttcaactcaagccgtattcatttcatcatccggttgccaaattcgatttgaccttgtcgattcaggcggaccaagacaactatcacggactgtttgaatattcgaaaaaactgtttaagaaaagcagaatcgaggttttatcaaacgactacttacacattctatcggcgattttggaacagccaagcattctaattgaacatatcggattgagcggcagcaatgaggaagaagagaacgcgcttgattctattcaattgaacttttagggaaaagcattatttctttaaattatataaaatgaggtgctccaatgtcggtatttaaaaaccaagaaacgtactgggaaaacctgtttgatgaagaagacggactaagcgcattcccttactttaaagcagcggataaagcgtcgttggcccgtaccggctaccaggaaaaatgcatctgccgttccttatctccggaagtatcccaaagaatcatgacaatggcgaatcattccgatatggcggcctatctgattttattggcgggtattgaatgcttgttatataaatatacggatcaaacgagcctgattcttggcattccgacggtatcgaagcaaaaagccggccagtcagccgttaacaacattgtcctcttaaaaaatacgctttcaaacgagagtacatttaaaaccgtattcgggcagctgaaagaagccgttaatgattctctgaaaaatcaaaacctgccgtttagaaaaatggttcagcatctgagcgtgcaatacaatgacgagcatctgccgttgattcataccgtcgtttcgcttaacgaaattcattccttgcaatttaaagaagatactgcagccgatacgctgtttcactttgatttggagaacaacggggttcatttgaagcttttttataacggcaatctgtacgatgagcgctatatcaatcaaattgtatcccatttggatcagctgctgtctgtgatcctgtttcagcctcaagccgcgatccatacggcagagattttaccggaagcggaaaaacagaagctattgtttgattttaacgacaccgtcagagatttctccgggagcagaacagtctatcaattatttgaagagcaagcagaaagaacgcctgagcatgcggccgtcaagtttaaaaacgaccatttgacgtacagggaactgaatgagaaggcgaaccgtttggcaagaacattgcgtaattgcggggttcaacccgatacgttagtcgccattctcgctgatcgttcattagagatgatcgtatccattatagccgtttggaaggcagggggcgcttatgtgcccctggatcctgaatatccaaaagagcggcttcaatatttgcttcatgatgcggatgcagacgttctccttgttcagcgtcatttaaaaaacagtctcacctttgacggcccggtgattgatttgaatgatgaaacatcataccatgccgatagctcattgttatcaccagcagcgggacacagccatttagcctatgtcatttatacgtcgggtacaacaggaaagccgaaaggagtcatggttgaacacggcggcattgtgaattcgctccaatggaagaaggcgttttttaaacattctccggcggatcgcgtgcttgttttgtacccgtatgtttttgatgcgttcattttaaatttcttcggcccgctcatctcgggggcaactttgcacctattgcctaatgaagagaataaagaaactttcgccattcaaaatgccataaaacaagagagaattactcatttctcaacctctccccgtcttctgaaaacgatgatcgaacagatgaatgcagaggacttcatccatgttcagcatgttgttgtaggtggtgagcagctggaaacagatacagttgagaagctgcattctctgcagcctcgcattcggatcaataatgaatacggaccgacagaaaacagcgtggtatctacatttcaccctgttcagtccgctgatgaacagatcacaatcggcagcccggtggccaaccatcaagcttatattttaggagcgcaccatcaaatccagccgatcggcgtaccgggagagctgtatgtcggaggagcgggagtggcccgcggctacctcaatcgccctgaattgacggaggaaaaatttgtggagcatctgcatgtccctggtcaaaagatgtataaaacgggggatctcgccagatggctgccggatggaagaatcgaatatttaggccggattgatcatcaagtaaaaattcgcggctaccggattgagatcggcgaggtagaggcagccatgttcaatctggaaaacgttcgtgaagccgcagtcgtcgcgcgggaagacgcagacgggtccaaacaattgtatgcctattatgtcggcgagccttctttgacagcagcgcagttcagaaaagaattatcccgggaactgcccaattatatgattccctcccgctttatcccattggaacgcattccgctcacttccaatgggaagattgatctgaaagctttgcctgctgctgacgaaaatacgcgggcggaatacgaatacatagccccgcggaacacaatagaagaactgctggcgtccatctggcaagaagtattaggggcagaacgtataggaattttggataatttctttgattttggcggagattcgattaaatcaattcaggtatcatccagattgtatcaagccggatacaaggttgatatgaagcatttgtttaaacacccctcgattgctgaacttagtcagtttgtagcgccggtcagcagggtggctgatcaaggagaagtgaatggcggaaccaagctgaccccgatacagcattggttttttgaacaaaacatgccgcatgcacaccattacaatcaggccgtcatgttatattcggcggaatgctttaaagaggctccgcttcgccggacgatagaacagatcgcgtcgcatcacgatgccttgaggatgatttttgaaaaaacgccggatggatacgctccgcgaattacaggaacagatgaaagtgaactataccatctggaagtgatgaattataaaggggaaaccgatccggctcaagcgattgccgataaggcgaatgagattcaaagcagcatggtattagacaaagggccattgatgaagctcggtttgttccaatgtccggacggagatcatttgctgattgcaattcatcatttgctgattgacggagtatcctggcgtattttgctcgaggattttgcaagcggttatgagcaggcagaacgcggacaaacgatccagctcccgcaaaaaacagattcgtttccattctgggccgatcaattgtccaagtatgcggcggaaaccgatatggaagaggagattgcgtattggactgagctttcaagcataaagcctcagccattgcctaaagacactatcagcgaaggatcgttattaagagacagccaagaagtgacgattcaatggacaaaagaggaaacggagcaattattaaaacaagcgaaccgcgcctacaacacggatatcaacgatctgctgctgacttcgttagggctggccgttcacaagtggacaggcacggaagacattgtcgtgaatttagaaggccacgggagagaaccgattattccggatgctgacatttcccgcacgataggatggttcacaagccagtaccctgtcgtcctgagaatggaagccggaaaaaacctgtcgcagcggatcaagatcgtgaaagaagggctgcgccggatccctgataaaggaatgaattacagcatcatcaaatatatatccgggcatccggaagccgacagcctgcagctgaatccggagatatcgtttaactatttgggacaatttgaccaaaacctgaagcatcaggctttgcacatatcgccatattccacagggttatcgatgaacgaaaaccaagagagaacggccgtgcttgatttgaacggcatgattaccgaagggacattatcactgacactgagctacagcagcaaacaatacgaaagatctactatggcgcaatttgcccaagggttgaaagaaagtctgcaagaagtcattgcgcattgcgtaagccggcagcagacttctctcacaccaagtgacatcctgttaaaagatatctcaatcgacgaactggaacagcttttggagcagacgcgtgaattaggcgaagcggaaaatatttatccattaacgccgatgcagaagggcatgctgtttcacagcttatttgatccgaattcaggtgcttattttcagcaaacgatgtttgatctgcatggagatctggagattgattcattttcaaaaagcttggacggcttatcgcaaaaatatgatattttccgcacgaatttttacagaggctggaaggatcagccgctccaaatcatattcaaaacgaaaaaaatcggttttcaattcaatgacttacgagagatgaaggaatcacaaaaagaagcgatgattcagcagtatgcccgagaagataagatgcgggggttcgacttagaaaaaggcgcgttaatgcggctattcatccttcgtacggatgaaaagacataccgttttatctggagcttccaccatattttgatggacggctggtgcctgccgctgattacaaaagaaatattcgagaattactttgccttgcttcagcaaaagcagcctgaacaatcatcaattactccgtacagtcaatatattgaatggctcggccggcaagatgcgaaagaggccacggcttattgggatcagtacttggagggatatgaggagcaaaccggccttcctaaggatcatcatgcagcggaagacggacgatacgttcctgaaaaagtgacgtgtgacataagctccgatctcacttcgaaaatgaagcggacggcaggcgagcatcatgtcacgctgaatacgctgctgcagacggcatgggcggttttgctgcagaaatataaccgcagccgggacgttgtgtttggaagtgttgtatccggaagacctgctggaattccaaacgtggaaaccatgatcggcttattcattaacaccattcccgtccggttccggtgcgaagccgggacaacgtttgccgagcttatgaaagaggcgcaggaaagggctgtagcgtctcaacaagttgagacgcacccgctgtacgatattcaagcgcgtacaacgcaaaaacaagatttaattacacatttaatgatattcgaaaattatccggttgatcagtatatggaaagtataggccgccagaacggaacatccatcacgatctccaacgtgcaaatggaagaacagaccaactacgattttaatttgaccgttataccgggcgacgagatgaccatctcttttgaatacaatgcaaatgtgtatgatcgggcaagcatagagcgggttcgggaacatttcatgcaaattctgcaacaagtcgtgacaaatgcggatatccgggtggatcaagcagaattgttaacggaaggcgaaagaagaacccttctgcagacgcttaacgacacggccgcgccgtttccgcagacgccggttcatcaattatttgaagagcaatcgcagcgtacgcccgatcaagcagccgtcattgataaggacaggcagctcacgtacggagagctcaataagcgggccaaccgactcgcgcgaacgttaagagcgaaaggagtccagacggatcagcctgtagccatcatcacgagaaacagcatcgaatcggtggtcggaatccttgccgttttaaaatcagggggagcctatgtccctatagatccggaatatccgcaagaccgcatccggtatatgctggatgactcccaagccggaatcgttttaatgcagcgggacgtcaggaaacagcttgcctatgaaggcgtcacggttttacttgatgatgaaagttcttatcaccaagatggctctgaccttgctccgataaatgatgtgagccatttggcatatgtcatttatacgtcaggttccacaggccggccgaaaggcgtactaatcgagcaccaaggcttgaccaattatatttggtgggcgaaagaggtttatgtaaaaggcgagaaagccaacttcccattgtattcgtcaatttcttttgatctgacggtgacttctattttcacaccgcttgtcacaggaaatgcaatcatcgtctatgacggagaagataaaaccgctctgcttgaatcgattgtgagggacccgagggtggatatcattaaattgactccggcccatttgcaagttttgaaagaaatgaacattgccgatcaaacggctgtccgaagaatgattgtgggcggggaaaacttaagcacccggttagcccgcagcattcatgaacagttcgaaggccgggttgaaatatgcaatgagtacggaccgacggaaaccgttgtcggctgcatgatttaccgttatgatgccgcaaaggacagacgggaatcggtaccgatcggaaccgctgcggcaaacacgagcatttacgttcttgatgagaatatgaaacccgcgccgatcggagtgccgggagaaatctatatcagcggcgccggtgtggcaagaggatatttgaagcgtcccgaattaacggcagagaaatttgtcgatgacccgtttgaacccggagcgaagatgtataagaccggagatttggcgaagtggctgacggacggaaacattgaatatgcgggcagaatagatgaacaagtgaaaatcagaggctatcgtatcgaattaggcgagatcgaggcggcactgcttcaagaagaagcgatcaaggaagctgtcgttacagccagagaggatgtccacgggtttaaacaattgtgtgcatattacgtaagcggcgggcaaacaacggctgcccggctccggaaacaattgtctcatacccttgcaagttatatggttccggcttattttatcgagcttgatgaaatgcctttaacttctaacggaaaaataaacaaaaaagggctgccggctccggatttcgagctgcaggacagagcagagtataaagctccccgaacaaaagcggaagaaatattagtttctgcctgggaatcggtattaggcgctgaaaacgtcagtattcttgataatttctttgaccttggcggagattccattaaatccattcaagtatcctccagattaaatcagcaaggatacaaaatggaaatcaaagacttgtttcaatatgcaacaattgcagaattgagtccgcatatcaagcagaatctgcgtatagccgatcaaggtgaggtcaaaggaaaagtcagcctgactcctattcagcattggtttttcgaacaaataacgacagatcagcattattataatcaagccgtcatgctgcatgcgccggaaggttttcaggaaacgcagcttcgtcaaaccctgcaaaaacttgctgaacatcacgatgcgctccgcatgacgttccggactacggaaaatggctgcgaggcacagaatgaagaaatcgcccaaagcggactgtaccgcttagaagtcctgaatctgaaagaagattccgatccgggacggacaattgaagccaaagctgatgagatacaaagcagtatgcgtttaagtaatgggccgttaatgaaagccgggttgtttcaatgcgcaaatggagatcatctgctcattgccatccatcatttgattatagacgggatttcatggcgcattttactggaagatatcgttagcggctacaagcaagccgagaatgggcgagtgattcaactgccgcaaaaaacagattccttccaattatgggctaagagactttcagaatatgcgaaaagtgaaaccataaaacaggaacaggaatattggacaaagatcgaacaaaccgaagtcaaaccgctgcctaaagattttcatgaaacccatacaactgcaaaagacagtgaaacagcaactgtggaatggacgaaagaggaaacggagctgctattaaaacaagcgaatcgcgcttataacacggagataaacgatttgcttttaacttctctcggtctttccatatcgcattggtcaggactggaacaaattccgattcatttagagggacacggccgagaacagattatacaagatatagatatctcccgcacggtcggatggtttacaagtctgtatccggttgtgctgcacgcgcagccgggcaaagagatctctgattatatcaagacgaccaaagaaggattgcgccaaattccgcataaagggatcggatatggaatagcaaggtacttaagcggcggaatgccatcgaaactcaatcctgagatcagctttaactacctgggacagtttgaccaagatttacagcagcatggggttcaattatcttcttattcttgcggttcagactctagcggaaatcaagaaagaccgtatgtattgaatataaacggaatgatcaccgacggccggctgaagcttacgatcagctacagcagcaaacagtacgcaaaagaaacgatcatgcggttatcggaaacgattcaaagccgcctgcggacaatcattacgcattgcgtccatagagaacaatcggaactgacgccaagcgatattttgttaaaaggcatgtcgattgacgaattggatcagctcctcattcaactgccgcatgcaggtgaggttgaaaacgtgtatccgctcactccgatgcagaaaggaatgctcttccacagcctgctggacgaggcctcaagttcttattttgaacaagcatcgttcgatttgcagggagaattaaagattgattggtttaaagcaagccttgaacgattatttgaaacatacgccgtgctcagaacccgtttttacagcggctggaacgatactcctttacaaattgtctataaaacgcaaacaccgcaaattcattttgcagatttgcgtgatatagaggagcacctgagagaggatgcaatcgcagcctatcaaagagaagataaggcaaaaggatttgacttggctcgggatccgctgatgcgcatagcgattttccgtatggaagaccgcaaatatcatttgatttggagcttccatcatattgtgatggatggctggtgcctgtctcttatcacgaaggaagtgtttgatcattatcgcgccttacaagaaggcagggaaccagaaccgtcatcggcagctccttacagcaactatatcgagtggcttgaccgccaagatcagggagcggcaaagcggtactggagcgggtatctcgaaggatataaaggtgaaaccacgcttcttcataaaatagagcagcatgaacaaaaagaatacgcctatgccaatgtgatctgccgatttgatcacgaacagacaaaacaattacagcagatcgcaaatcagcatcaggttacattaaatacgttgatccaaacgttatggggagttttattacagaaatacagcgggtccgcagacgttgtcttcggcagtgtcgtgtcgggaagaccggcggaaattcctgatgtggaacagatgatcggcctgttcatcaataccattccggttcgcatccgctgcgatgaggacagcacttttgctgatacggtgcaaatggttcaacaaaacgctctggcttcccaatcatacgatacctatcctttatacgaaattcaggcccaaacggaacaaaagcagaacctgattgaccatatcatgatttttgaaaactatccgatcggtctgcaggtcgaagagacgggacatcatagtacggagctgaacattacgaattttcatatgctggaacactcccactatgatttgaatgtggttgtcatacctggcaaacagctggccgttcatttcggttttaatgaaaacgaatatgaaaaatcagaagtggagcggatctgcggacattttgaacagctcatgcagcaagtattacagcagccgtctgtcaaaatagaagaattggagcttctctctcggcaagaaaaagaacatttgctcagccgctttcagtctaatgacatgcattacccgcttgaacaaacgatacatgagctgtttgaggaacaggcgcatcgtactccggacaatacagcggttgtattcgagggtaaacaactcacctacggagaactgaaccggcgtgccaatcagcttgcgcgaaccttgcaggcaaaaggtgtgcggaacgataagcttgtcggtattatgactgaacgctcgcttgagatgattgtaggcatcttgggagttttaaaagcgggcggcgcatatttgccgatagatcctgattctccgtctgaacgcatcagttatattttaaatgattcaagcatcagcgtattgctttaccgcgggaagctgcaggatgacatcggcttctcaggaacatgtatcgatctcatggaggaacatttctatcacgaaaaagacagcagtcttgcactctcttatcagtccagtcaactggcctatgccatttatacttccggtacgacaggcaagcctaaaggcacgttaattgaacatcgccaggtcattcacctgattgaaggacttcgacgccaaatttactctgcctacgatgcggagctgaatgtagccatgctcgctccatattatttcgatgcttctgttcagcaaatgtatgcttccttgctgtcaggacataccttgtttattattccgaaagagattgtgtcagacggtgctgccttatgccgttattatcggcagcattcgattgacatcaccgacggaacacctgcccacttaaagcttttgatagctgcaggtgatttgcagggagttccgcttcagcatcttttaatcggaggagaggcactttccaaaacgacggtaaataagctcatgcaattattcggcgatcatggcgcttcacctgggattaccaatgtatatgggcctacggagacttgcgtagacgcgtctctgttcaacattgaatgttcttccaatgcgtgggcacgcagccaaaactatgtccctataggcaagccgttaggcagaaaccgcatgtacattcttgattcaaaaaaacggctgcagccggcgggcgtccaaggcgagctgtatattgcaggggacggtgtcgggcggggttacttgaacctgccggaactgacggacgaaaaatttgttgccgatccgtttgtaccggaggaccgaatgtacagaaccggtgatctggcccgccttctgccggatggaaatattgaatatatcggccggattgatcatcaggtgaaaattcaaggttttcggattgaactcggtgaaatcgaatcggtgatgcttaacgttcctgatattcaagaagccgccgcagctgcccttaaagatgcagatgatgaatattacttgtgcggatactttgctgcggataagacaatacagatcagtgaacttcgcgaaagaatggcccggcatttaccgggatatatgatcccggctcaatttgtgcagctggataagatgccgctgacgccaaacgggaagttgaatcgtcagttattgccggctccggtcaaaaagcgtgacggcggcatagagtacgtcccgccgcaaacttcggaagaaatccagctgacagcaatttgggaagatgtcctcggattagagcaggtggggatcagagatcacttttttgagatcggcggacactccctgcgggcaacggcgctgattgcaaaaatacaaaagcaattgcatgtccaaattcctttgcgggacgtcttccgtctcccaaccattgaacagctcgcacagacgatcacgaagacggagctgaccggatatgctgcgattcctgcaattgaaaaaagaccttattatccggtatcctcagcacaaaaacggttgtacatcctgaatcacttggaaggcggagaactcagttacaacatgctgggactgatggctgtcgaaggcaagcttgaccgtgacaagctgcagcaagccttccgcacgctgattttgcgccatgaatctttgcgcaccggttttaaaatggctgacggagaacccgttcagtatgtcttagatcacgcaaagttcgaagcagagtggtatcaggcagaagaaaatgatgcggacctttatatccgcaaatttattcgtccatttcatctggatgagccgccgctgcttcgcgtggggctgattgaacttcaacctgaccgcggaattctgatgtttgatatgcaccatattatttctgacggaacatccatgagtgtattgattaaagaatttatccgcatttatgaaggagaaacattaccgcctttgcgcatccagtacaaggactacgcagtatggcagaccggcgaagcgcggttaaaacagatccaaaatcaagaagcctattggttagagctgtacagcggcgacgttcctgtccttcatctgccgaccgattatatccggccgtcggcacgggattttgcgggagccacaatgcagtttacgcttgataagcaaaaaagcgccgggttaaagcagctggcatcccaaactgaatcgactttatatatggtgctccttgcgtcttatacattattgctttcaaaatacagcggccaggaagacataattgtcggcagtcctatagcgggaagaccgcacgccgatttggaaccgattatcggaatgtttgtgaatacattggccatgagaaattaccctgaaaaagggaagacgttctctcagtatctgtccgaggtaaaggagaatgcattaaaagcttatgagcatcaagattatccgttcgaagcgctgatcgatcaactgaatatcgcaagagacttgagccgtaatccattgtttgacaccatgtttgtgcttcaaaacacggagcaggaacagttagagataaatgacgtcactttcaaaccatatccaagcgaacatacgatggctaaatttgatttaaccttaacggcggtggaagaagagtcgggtattcagttcacaatggaatacttgacggctctgtttaaaccggaaacgatcgaacgcatgatggggcattttgtgcagctgattgattcgattattaaacagcctgatgccgagctggctcgtttgaatatgatgaccaaggaagaggaaggagacattcagcaactctttaacgatactgcagttgcggaaaaacgaattccgacaacgattcatcagctttttgagcagcaggctgagcttaacccggatcatgaagccgtcatgtttggaattcagacactgacttatcgtcagctgaatgagcgttccaatcagctggcgcgcatccttcaagataagggggcctgcactgatcaggttgttgccgttctcacggatcgctcaccacatatgatcatcggcattttagccatattaaaggccggcgcagcatttcttcctattgatccggagcttcccgaaaaacggcgggcttttatgctgaaagacagcggtgccggtgtgcttttgacttgtgcaggccacgctattccgccgcgctttgaaggagaagcgcttcagcttgatgatccgatgatatatcaaggcagagcagacaatcttaatctttcctgctcggaaaatgatttaatgtatgttatttacacgtcaggcacaacggggcagccgaaaggagttcagctggagcacaagacgatgacgaatctgctcgcttatgagcaggatcatacgcagcttcgctttgacagagtgctgcaatttgccgcgatgagctttgatgtctgctatcaagaaatgttctccgcgctttcaagcggaggaacactctttatcatcggcaatgaggcaaaacgtgacatacgtcagctcaatgattttgtcaaaacgcacgggatacaaacagcattcctcccgacagcgttccttaagctccttgcctcagagaaacaatatttcgaaccgtttgccgcgtgcgtggatcacatcatcgctgcgggagaacagctcatcgtaacaagtatgctgcgtgacatgctggcacgccatcaagtcacattgcataatcattatggcccgtcggagacgcatgttgtgaccatgtataccgtcgatcctgatacagatcaggagcttcagccgatcggcaaaccgatttcaaatacggagattttcattttgaatgaagccggaacgcttcagcctgtcggaatcgtcggtgaactttgtatttcaggagcgagccttgccagaggctatcataacagggagcctttgacactcgaaacttttgttccgcacccatatgactcgaatcagcggatgtataaaacaggcgatctggcccgttaccttcctgacggaaacattgaatatgcgggaaggagagaccaccaggtcaaaatccgcggttaccggattgaactcggtgaggtggaggccgctcttctcaagcacgtacaggaagcagttgtcctatcaaaagaaaataccgatggccaaatcgatttatatgcctattttacagcggagcaatcactctcgatcagtcagctgaaagaaaaacttgctggccaaataccgggatacatgatcccttcatacttcatccagcttgagaaactgccgctaaccggcaatggaaaagtaaatcgaagagcattaccgatgcctgaagcaggtttacaaacgggaaccgactacgttgctccgcggacgaatatggaagagcagctgatatgcatctggcaagacgttttgaaggtaaaagaaataggtgtaaaagataactttttcgatttgggcggccactcgttgcgggggatgacgctcatcgccaaaattcataagcaattcagcaaaaacatttcattaagagaggtctttcaatgtccgacagttgaggaaatggcaaaggcaattgcaggagctgaaaccaacgggccggattacattccgaaagccaaagcaaaagatgtctatcctgtatcttccgtgcagaagatggtttacctgtcaacacaaatagaaggcggagaactgagctacaatatgccgggaatccttacattagaaggaaaactcgacataaataacttgcaaaccgctttccaaagactgatccagcgtcatgaatcactgcgtaccggttttgagctggtccgcggagaaccggtgcaggtgatcaaaccgcaagcggagttttcgatggaaagatacaaggcaacagctgacgaggttgaggaatgtttccgcaccttcgtgcggccgttcgatctcagccaggctccattactcagggcgggactcatcgagttagaacaagacctgcatattttcatgtttgacatgcaccacatcatcacggacggcgcctccatgaatatttttgtcgaagaactgattcaattgtatgacggcaaagagttagctccgctccgtattcagtacaaagactttacggaatggaaacatcaaaaagagcaaagagaacgaatcaagaagcaggaagggtattggcttggtgtatttcatgaagagctgccttcatttgagcttccgaaagattttgcgagaccgccggttagaagctttgatgggaaaaggcacaattttacgctcgataagactgtcacccaagggataaagcagctggaagaattgaccgggacgacagcttacatgattttgttctcggcctattccatactgctggctaaatacagcggtcagggtgatatcgtcgtcggcacacctattgcggggagaccgcatgcggatttggaacccattatcggaatgtttgtcaatacattagccatccgcaccgctccgatggcggaaaagacatttttggattatataacggaaacgaaagaaaccatgctgaaggcttttgaacatcaagagtatccttttgaagaattagttgaaaaactgggtgtaaaacgggacttaagccgcaatccattgtttgatacgatgtttgtcctgcaaaatacggaacaaacggatattgaagtggactctctcgcagtcaggccttatgaacaaacagagacggcagccaagtttgatttacagctgaacttcttaatagatcaagatgagattcagggcagttttgattactgtacaaaactgtttaaaaagaaaaccattgctgtattggccaaggattacgtcatgatcctttcggcgattatgagaaacccatccattcctttaaaagacattcaattaagcgaaaaagtaaacaaaagtaaacatctcgcaagcacaatcgaattggatttctaatcacgggggcagcggctgtcccggcatgaatgccgcggctgccgccagctgcctgaaaacaggaatgaaaccaactggagggatatgaatgtcagaattcaaacaacaggagttgttctggggccgaatgtttcacacggaagaccgtcccggtgcattcccttcgtttcaagtgtccgactcaacagtaaagcgtgatataacaagcggatctgactgtattcacagttcattgagtgcggaggtatcacggcgcatcctgaccatgacgaaccaaacgccaatggccgtctatctggttctcctggtcggaattgaatcccttttatacaaatacacgggggatgagggagtgattacaggggttccaacctttgaagacgaaactgatgaagatcttcgttcagaccagctcatgttaatcaaacagcatatcaattccggcagtacgtttaaatcaattttccatgaattgaaacatacgctggacgaagcgatcttatatcaggacgttccctttgataaaatggccggacagctgaggctgaactacaatgcaaatcatttgccgatcatccatacagttgtttcactagagcaaattcattctgatggtttcatagaaacggctgctgcggatgctttatttcagtttgctatgggtgaagacttgattgacctaaaattatgttttaatgaacaagtctatgaccgtcagtatatgatgcaggtgctcggacatttaaaccggctattttctgtcatattatttcagcctgacctccccctcggccaagtggatattttgccagaatcggagacacatacacttctcgttgacattcaaactgcgaaaactgaatatccgcgggataagacggtttatcagttattcgaagaacagatgaaacgaacaccggatcaagcagccgttatttacggagaaaagcaattcacatatcgtcagctcaatgaacgtgccaatcaattagcccgaacgttaaggaaaaagggggtaaagacggaccggctcactgcgattatttgcgagcatgagatcgaactggtcgtgggaatactggccgttttaaaagcgggaggggcctatgtgccaattgatccggattatccgaagcatcgcatacagtatatagtagaagactcccaagctgatatcatcctgacgcagagccatcttcaaaaacagttggaacttgcgggcacaatggttttcctcgatcaggaaagctcttaccacgaagacggctctgacctggaaccgatcagcagtacgaaggatttggcttatgtcatttatacgtcaggctccacaggcaagcctaaaggagtggcaattgagcatcagggcttaaccaattatatttggtgggcccgccgggtctatgtcaaaggggaaaaaaccaactttcccctatattcgtccatcgcttttgatctgacgataacgtctgttttcactccgctcattacaggaaattccattattgtctacggaggagaaaacagtgctgccttgcttgattgcattattcaggattcaaggacggatattatcaagctgaccccggcgcacttgcagttattgaaagagatgaatatccctgctgagtgcaccattcggaaattgattgtcggcggtgacaatttaagcacgcggctcgcccgtagcatcagcgggaaattcggcggaaaaatcgaaatttttaacgaatacgggcctacagagacagtcgtcggctgtatgatttattcctttgatccgcaaaacgacagacgggaatcagtgccgatcggaaccgccgcggacaacatgaacattttcgtgctggataagagcatgaagccggtgccggccggcgttccgggagaaatctatatcagcggggacggcatcgccagaggatacttgaacagagcggaattaacagcagaaagatttttgcagcacccctttgtgccagaggtgaaaatgtaccggacgggagatttagcaaggcggctcccggatggaaatattgaatatttaggccggatcgaccaccaggtgaaaatccgcggttaccgcattgaaatcggggaagtcgaatccgcatttttccaaataccgccgattcaagaagctctcgttacggcacaagaaaccaacggggaaacatccttgtgcgcctattataccgcacagcattctttaaccgcaggcgaaattcgggagcgcctgtcccggcaacttccgtcctatatgatccctgcttattttgtacagctggcagcgatgccgcttacttccaacggaaaaatagatcgtcaggctctgcctgctccaacgggaaatctcactggaaatccttatacagctccgcggacagaactggaaaaaatactggccggggtgtgggaatcggtattaggcgcagaacaggtcggaatcgatgatcatttctttgagctgggaggagattcgattaagtcgattcaggtgacctcaagcttatatcaagccgggtataagcttgacatcaaacacttgttcaaacacccgacgatctccgggcttgctccttttattgagcccgttacccgaatcgcagaacaaggggagatcaaaggccgtaccttattgacgccgattcagcattggtttttcgcccggcaataccctgatccgcatcattataatcaatctgtcatgctttattttaaagggggtttggacgaatcgaagcttcagaaagtcatgaagaagattgccgagcatcacgatgctttgcgcatggtctatgttcagggagatcatgaatacgaagccagaacccgcgggatcagtgaaggagaattattcagcctcgacgtgttctctttactcgaagaaaacaaccctgccgaaacgatagaaacgatagcaaatgacattcagcaatccatccatttagccgatggaccgctcatgaaactgggattgtttcaatgtcaggatggcgatcatttgctgattgcgattcatcatctggttgtagatggcgtatcgtggaggattttacttgaggatataacgtcagcttatgagcagctccaaaacggagaagcgctcacgctccctaagaagacggattcctatctgttatgggctgaacgattgaaacgttatgcagaaagtccggaatttgaagcagaaaatcaatattggcttgagcagaaacatatctcgcaacacaaattgccaaaggataatgagcaggagaccggtctggccgaagaccgggaaacgatcatcgtccaatggacagaggaagaaaccgagcatttattaaaaaaatcgaaccgggcctatacgactgacattaatgatttattgctgaccggactcggaatggctgttcatcgctggacggggcatgaagaaattcatgttcatctggaaggacacggcagggaatctatttttcaagacgttgatatttcacgtacagtgggctggttcacaacccaatacccggtttctcttcaaatccaggcagaccgggacatctcccagcggattaggacggtgaaagaacagctgcgtcagattccccaaaaaggaataggatatggcctgatgaaatattcgtccgatcatccgaaggcatcagaatggaccggacatccggaaatcagcttcaattacctcggacaatttgatcaagatttcgaaaatggaggaatcgaagtatctccttactccggagggaaaattgcaagcgacagacatcccattgcctatacgcttgacattaacggcatgatctcagacggccggctgtcattggccatcagttacagcggtaaacaatatcgaagagaaacgatggaaacatgtgcagctctcttaaagaacagcctaaaagaagtcatcgaacattgcgcagctcaagaagacattcacctgacgccaagcgatatctcactgaaggacataacaatcgaggaattagatcaatttgttcagcaaacacagcatatcggcgagattgaaaatatatatcctttaactcccatgcagaaaggtatgctgttccatagtttaatcgattcggcttccagagcttactttgaacaagccgtttttgatctcaaaggcggcttggatatcgaggcatttacaatgagtttgtcgcagctggcggaaagacatgagattctccggactcatttttatacggaatggaaagatcagcctttgcagatcgtattccgaaaaaaaccgatcgaaataactgttgaagatattcgaagcatgaagaataaacaacgaaacgagttcattgccggctttgtacaaaaagataaggcaagaggattcgaccttacccaagatgcattaatgcgcgtatcaatccttcgtacagaggatgaccaagtccgattgatatggagcttccatcatattttaatggatggctggtgtctgcctcttattacgaatgaagtatttgaaacctattatgcgattcttgatagaagaaaagcggagcgggaagtcgtcaccccgtacagccgatatatcgaatggctggaagaccaggatcataagcacgcttcagcctattggcaaaaatatttggacggttatgaaggacaaactgttttactgaaagaacctgtctcaaaccaagccaagggatatcaaaaacaaaggcttgcatgccggctcggaaaacagctgtcagaagaaatcagacagactgcaagcaagcatcacgtcaccgtgaatacgttcattcaaagtgcgtggggactattgctgcaaaggtacaacaacagtcaggatgtcgttttcgggtcggttgtatccggccgaccggcagaaattccgggtatcgagtccatggtcggcttatttatcaacaccattcccgtccgtattaccgctcagcctggaatgactgtggaacaagtgttgaaaatgagccaggagcaggcattggcttctcaagggtatgatacatttccgttatatgaaattcaggctcaaactgaacaaaagcagcagctgatcagtcatatcatggtatttgaaaattatccggtcgagaaacaaatggagcatatgaaaccgaatcgtgacgcactggacattatcaatttccatatggaagagcatacccattacgatttcaatttcattgtcatgcccgcgggagaaatcgacattcattttgtatacaatagcaacgtctatgatcatgcaagtgtcaagcggatggaagagcattttatgcaaatcattaagcagatggtgaacagtcaggcgattcgcgtccaagacttggatatacttacgggggatgaacgttcgctccttatagaggcatttaatgatacggaagcagattatccaaaggaaaagacgcttcataaattgtttgaggaacaagcacagcgtacgcctgatcaaacggctgtcgtatacggggaaagccagctgacataccgggaactgaatgaaagagccaatcaacttgcccggacattgcaatcagaaggcgtgcagccggatcagccggtcgggattatggccgaacgttccttggaaatgatcgtaggactcttcggaatcttaaaagccggcggcgcgtatgtgccgatcgatccgagctatccggaagaacggattcactatatattggaggattcggatacgaagctgttgttagtacagagtcacttgaggaaaagcgtgccttttacgggaaaagtgcttgacctggaagatccgcgattctcttgggaagatggttcaaacttgaaacagacggccggaccgaatcacttagcttatgttatctatacctcgggatcaacaggccgaccgaaaggggttatggtggaacaccgatccgtaatcaaccgtctcgtttggatgcagaaacattacccgctggataagcaggatgtcattctgcaaaaaaccccaatcacctttgatgtatcggtgtgggaattgttctggtggtcgatgactggttctaaagcagtattgcttccaaacggaggagaaaagaaccctgacgtcatcttagatacgattgcgcagaaaaatgtcaccgttatgcattttgtgcctgcgatgctgcatgcttttcttgagtccatggagcagaaatccgaagaggaattaaagagaaagctggcgtcattaaaatatgtatttgcaagcggcgaggctttgacgcctgtgcacgttgccgggtttcatcgcttgatcacaccggcgggtgaggctcaaatcatcaatttatacgggccgaccgaagcgacgatcgatgtatcgtattttgaatgcgaagcgggagaaacgcttaactcagttccgataggtaaaccgatttccaacattcaattgtatatcgtacaccccgaatcggaatattttcaaccgctcggtgtggcaggagagctgtgtatcgccggagacgggctcgcacggggctatttgaaccgcccggagctgacggctgagaagtttgcagctcacccatatgaagcagggaagctgatgtaccgtacaggcgacttggcaagatggctgcctgacggcaatatcgagtatttgggaagaattgatcatcaagtgaaaatccgaggctaccggatagaactcggcgagatcgaagcatctttactacaactcgatgctgtcaaagaagcggtcgtcatcgcgattgaaaaagagggctcaaaacagctgtgcgcttacttgtcaggagacgagtcattaaatacggcgcagctgaagcgtcatttgctgaacaatctgcccacgtatatgattccggcttattttgtacaagtagagaagatgccgataaccgctaatggaaaaatcgatcgaaaagcgttgccggctcctgagggaaataggcttaccggaaccgaatacgcagcgccaggaacgttaattgaaaagcagctggccgatatatggaaggatattttagctctgcctgaccccgggattaaagatcacttctttgacgttggcggccattcacttaaagtattgcagctcattcatcaaattaacgccagtatgggaatcaacatgcattatcaagccgtatacgattttcctaccatcgaaacaatggcacgcgccattcaagcggccgttttcgaatccgagacggataacgtattcgtcaagctgaatcaggaagattcaatccctgtgttctgtttcccgcctttaatcgggtatggactcgtttataatgaaatggcgaaaagacttgacggcgtcagcaccatctatgccgctgatttcttagaagagccgtctcatgggaaagagatcgttgaccggtatgcagagagcatgataagcattcaagaacaagggccttttgttctgcttggttactcttccggatcgaatttggcttttgaggttgccaaagccttagaaaagcgggggcgcaccgtatctgatgtgattatgctggattctaaaatcaccgattcggtaactcatttatcggaagaggaaatccaagagatcgtccatctgaatatggacattattccggactactacagagaaatattaaccattccttcgattaaggataaaatcagaggctatcttgcgtatcacaatgaactgatcaattccggcgccgttaacgccaacatccatcatttgctatgcggcgatgtaaccgatgataggggctggacacaatcaacagcacagcattatcttgagtacaaattaaaaggagatcacgtgacgatctttgaacctcacaatatcgaagaaaatacggatgcaattcgatctattattaaacggattgaagaacggcatcatcacggacttgttcttgaagaacaactgtcaataggatcgtttgctggcgacacgaagtttgacaaaatgtaaatgatcaagtgtaaaacgccgctggcctggcactcagcggcgttttttattaaaaaggcgagagtcatactcctgtgttcgcaaggcttactccagagccgttctccatgaccggttgtcatcaaatggtaaaaaaatcatcatacattttaaggaaaaagaaggatgtcaagttattagaaaaaagtgtagcgtatgtttatgggtactagctctattattgagtttcttaactgcggagtctgctttttactgccggtactgcaatttgttctcaaatggtaaaagttccccgaatttaaagaaaaaggaggagcgttaagttatgtgtaaaaaatgttgcgtatgcctatgggtccttgctttattattgagttgcttcactgggaagtctgcgtatgctgccagcactccaattgcaaaacatgttgggaattcaaatccgcttatcgaccatcatctgggcgcggatccgtttgcgctgacctataacggaagagtctacatctatatgtcaagcgatgactatgaatataatagcgacggcacgattaaggataattcatttgccaatttgaataaaatatccgtcatatcttcagcggatatggtgaactggacagatcacggagcgattcccgcagcgggtgccaatggggtgaatggcggccgggggattgccaaatgggcaggagcatcatgggccccgtcagccgcggtgaaaaagatcaacggtaaggataaatttttcctttatttcgcaaacggcggcggaggtatcggggttctcaccgcagacagcccgaccggtccgtggacagatccgatcggaaaaccgctggtgacgccaagtacaccaggaatgtccggtgttgtatggctttttgatccggcagtattcgtagatgatgacggtaccggttacctatatgccggcggaggcgttccgggcggttcaaatccaacgcagggacaatgggccaatcctaaaacagcaagagtcatgaaattagggcctgatatgaccagtgttgccggaagtgcatctacgattgatgcgccttttatgtttgaagattcgggaatgcataagtataacggaaaatattactattcctattgtatcaatttcgggggcgcgcacccggccgataaacctccaggtgagatcgcctatatgaccagctcaagtcctatgaattctttttcgtatagagggcactttctgaaaaatccgggagcatttttcggaggcggcgggaacaatcaccatgctgttttcaattttaaaaacgagtggtatgtggtgtatcatactcaaactgtcagctccgctctttacggggccggcaaaggataccgttctccccatataaataagcttgtgcataatccagatggctccctgcaagaggtagcggcaaattttgcaggtgtcaaacagctatccaacttgaatccatataaccgggtagaagcggaaacgtttgcctggaacggacggattttgacagaggcatcctcagcacccggcgggccggtcaataatcaacatgtcacaaacattcataacggagactggattgctgtaggaaatgcagatttcgggtcaggcggtgccaggacgtttaaagcaaatgtagcgtccgctctcggcggaaaaatagaagtgcgactagacagtgcaaacggtaagcttgtcggaaccttgaatgtcccttccacaggcggaacgcaatcctggagagaaatagaaactgcggtaagcggcgcatccggtgttcacaacgtattctttgtatttaccggaactggtacaggaaacttgtttaatgttgattactggcagtttacacaaagataagcaaaggtacgttttctaagtctataaaagataaatgaaggggaggaaaaaatgatgtcgagcgtaaaaaaaccattttgtgtattattggtatgtttcacaatgctgtccgtcatgctgttaggaccgggagttactgaagtttcagcagcaagtgatgcaacagttaatatatctgcagaaagacaagtgattcgcggttttggaggaatgaatcacccggcttggattggagacttgactgcggctcaacgggagaccgcttttggcaatggacagaatcagttaggtttttcggtcttaagaattcatgtagatgagaatagaaataattggtacaaggaagtggagactgcaaagagtgcgatcaaacacggagcaatcgtttttgcttccccttggaatccgccaaacgatatggttgagactttcaatcataatggtgacacatcagctaagcggctgagatacgataagtacgccgcatacgcacagcatcttaacgatttcgttaatttcatgaagagtaatggtgtgaatctgtatgcgatttctatgcagaacgagcctgattacgctcacgaatggacatggtggacgcctcaagaaatcctgcgtttcatgagagagaatgccggttccattaatgcccgtgtgattgcgccggaatcatttcaatacctgaaaaatatatcggaccccattttgaacgatccgcaggcgcttaggaatatggatatcctcggaacccacctgtacggcactcaggtcagtcagtttccttatcctcttttcaaacaaaaaggagcggggaaggacctttggatgacggaagtatactatccgaacagtgataacaactcggcggatcgatggcctgaggctttaggtgtttcagagcatattcatcattcaatggtagagggagattttcaagcttatgtgtggtggtacatccgcagatcatacggcccgatgaaagaagatgggacgatcagcaaacgcggatacaatatggctcatttctcaaaatttgtgcgccctggctatgtaaggattgatgcaacgaaaaatcctgagccgaatgtttatgtgtcagcctataaaggagacaataaagttgtgattgttgccattaataaaaataacacaggggtcaaccaaaacttcgtgttgcagaatggatctgcttcgcaagtatccagatggatcacgagcagcagcagcaatcttcaacctggaacggatctcaaagtaacggataatcatttttgggcccatctgccggctcaaagcgtgacaacatttgttgtaaaacgttaaaggcatcagcattgcattaagccaattttcttactcggaaaagaaaattggcttattttctgtgggagagaatgttgattttttaacgatacacggacattgggtataataatgacaatgacttcaaggagtgatcaatatatgtcacggcttcacagcaaaatattaatcatagacgatgaaaaagaaatttcggaactgatcaaaaccgtattaataagagaaggcattgatcgcgtagtgaccgcttcaactgcccgtgacggattggctcaatttcatcaagaaaatcccgatcttgtgatattggatatcatgctgccagacggtgaaggctatgatatctgcaagcaaataagggacatttcacacattcctattatctttttgtctgcaaagggggaggaaacggataaaattgtaggacttgccatcggcggggacgactacattacaaaacctttcagcccgaaagaagtcgcataccgggtcaaagcgcagctgagacgggtctcttacttacagccttctcaaaccggaaccgtgataaaaaaagggccatttgaattaaaccaacaacaagccgagctcaccaaaaatggagcggctattgagctaacacctaaagaacttatgcttatggcctattttctgcagcatcccaatcgggtgatcagtaaagaaacactctatcaagctgtatggggagaagactttttcggttctgacaatacggtgatggttcatatacgcaggctccgtgagaaaatagaaaacatcccatcaaaaccagactttctcgtcactgtgaaagggttaggctacaaatttgttgtaaaggatgcgtaaggatgaattggcgattaacaggcagatacatggtatctgtcatcatagtgaccatcattacagtcttcattaatttatttatttttatgttttggctcgttttacaggcgaacagccaacatgacgaagaaagtacaccggaaactttcacaagatcattcggacaatatgtcacgttatcgaacaatggtatcgcagtaaacaaagagggccaaaaagctttaaaagagcagaatgcatggattcaaatattagatgaaaacggacaggatgtttatcatgatagagaacctaaaggactgaagaaaaaatatacgcctattgaaattgtaaatttacataaatataaggatgaacaattattatcaaccatttacgccggcggaaaaaaagtaaacggcaaggagtacagttactttatagggtttaaaaatccatctctcggaaaatttgtcctctcatatgataccaaggaatttgtgacgaagttcaatacaggaaccatcatattattatcaatagatgcattgatcgcgttactcattggctatctattcagccggcagctcacaaaaccgctcggccgtgtcatccaaggaatccagcggttagctaatggagattatacgatcaaaatgaaatccaaaggcatttataaagatgtcttctataatgtcaatcacttatcggaacaactatctttaagcaaaaaagaaaaagataaattagagcaaatgcgtgaagagtggatcagtcatatttctcatgacattaaaacaccattagcatctattcaaggctatgcagaaatcattaaagatccgaattatcatctcacagtcgaacagatcagagattacgcccggatcattgagagtaaatcgctctatatgaaagatgtgatggaagatttaaatttaacgacaaggctgaaaaacaacgatgtgatgttaaatagagaacgggtaaaccttgtatcgctgctgcgggaaacgttaattgatattttaaacgattcgagatatgcggataagtccattgagcttcaaacgaacctggaaaagctgatgctgaaccttgatgcgatattgattcggagagcggtcacgaatctcattttaaatgccctcgttcacaatgatcccgatgtgaagatcgttgtacagcttgaacaaaaagaacgaactcatgtgacaattaaggacaacggcaaagggatagaagaagaggagctggaaaaagtgtttgaccgctattacagggggacaaatacaggaacgacgcatgcaggctctggtctcggaatggccatagcaaaggatattatccaaaagcacggaggggacatcaccattcacagcaccgcgggagaagggacaacgatagatatacaattatcataatggctatacaaaaaaaacggttctgctgattaataacagaaccgttttttcctattgttccgaaaacactttgattcctttgacaatgttccaaatgaaaaaatagatcgccacaaggaatgtaacagcataagtcgcaagcaggaaaggcccggcatgtctgatatcattcataccaagtaaacctgaagcgatgatgccgattccaaaaatcaaataaggaatcagatgcgtccacaaagattttttcgcatgttctttcacatcgtcccggcttaagaaatagacgataatcggaaacagaaacggcgcaaaaaatatactgaagtaacataatgaagacaaaattttattttctctcaaaccttttcacctctatgatttattgaagggggaattcttctggctgaatcccacactgaagtacaatcttattgtacaactccaaccttaacccgtattaatccgaaccttacatcaaccttaaattaacaaggacgggcaagggctcgtcttattacaatcataagattcaatgccatattgagactcatcacatttagcgcgtctacgtcagaaatacatttaatttttcgactcgattgaaaaatgacgtgtaaagtcccggttcagtccagttttctttgttctatatgtgtcaggtgcaactaattcaatagagaaagagcacattcacaggcttttacaccttctaaaaacaagaaattaggttgatagacaatcatgagaaagatttttacaatgagttcgtgctcataagaagtggagagccaaaatgatgagaaggaggaaaagatcagatatgaaacggtcaatttctatttttattacgtgtttattgattacggtattgacaatgggcggcttgcaggcttcgccggcatctgcagcagggacaaaaacgccagtagccaagaatgggcagcttagcataaaaggaacacagctcgtaaaccgggacggcaaagcggtacaattgaaagggatcagttcacatggattgcaatggtatggcgattttgtcaataaagacagcttaaaatggctgagagacgattggggcataaccgttttccgcgcggcgatgtatacggcagacggcggttatattgataatccgtccgtgaaaaataaagtaaaagaagcggttgaagcggcaaaagaacttgggatatatgtcatcattgactggcatatcttaaatgacggcaacccaaaccaaaataaagagaaggcaaaagatttttttaaggaaatgtcaagtctttacggaaacacgccaaacgtcatttatgaaattgcaaacgaaccaaacggtgatgtgaactggaagcgtgatattaaaccgtatgcggaagaagtgatttccgttatccgcaaaaatgatccagacaacatcatcattgtcggaaccggtacatggagccaagatgtgaatgatgcagccgatgatcagctaaaagatgcaaacgtcatgtacgcgcttcatttttatgccggcacacacggccaatctttacgggataaagcaaactatgcactcagtaaaggagcgcctattttcgtgacggaatggggaacaagcgacgcgtctggaaatggcggtgtattccttgaccagtcgcgggaatggctgaattatctcgacagcaagaacatcagctgggtgaactggaatctttctgataagcaggaatcatcctcagcgttaaagccgggagcatctaaaacaggcggctggccgcttacaaatttaactgcttcaggaacattcgtaagagaaaacattctcggcaacaaagattcaacgaaagaacgccctgaaacgccagcacaagataaccccgcacaggaaaacggcatttctgtacaatacaaagcaggggatgggggtgtgaatagcaaccaaatccgcccgcagcttcacataaaaaataacggcaatgcgacggttgatttaaaagatgtcactgcccgttactggtataacgcgaaaaacaaaggccaaaactttgactgtgactacgcgcagattggatgcggcaatctgacccacaaatttgtgacgctgcataaacctaagcaaggtgcagatacctatctggaactgggttttaaaacaggaacgctgtcaccgggagcaagcacagggaatattcagcttcgtcttcacaatgatgactggagtagttatgcacaaagcggtgattattccttttttcaatcaaatacgtttaaaacaacgaaaaaaattacattatatcatcaaggaaaactgatttggggaacagaacccaattagttaagctttaggcggacatcagcaacgatgtccgcttttattatcttaaacagcaatacatggaggtttacgtgaaggagtagatatgattcactcaacatataatgtaatcgttttacagttttgaaaagtgtttaaagcgcaatgtatgtatttcacacccgccacttttattacttaagggggaacaagagaatgaaaaggtatgatgcatttccagagccgattggcggctatactgtcggccgcacccaactggattttgagtacacggcatcagatcatacaaaaagagaactgacggcgtttgtgtactatccgtccgacagcagcgaagggaagactacatcaacgtacatgtttcctgaagtctgcgaaatgcttgatgagcagccgcttctcactgcgcggaagaatgcttactctatagatatcaagacccaatgttacgacggccttgctctctccgggaaggaaaaacgctatccggtgttattctatgtttgcggcgggggcggttcttcagaatggggcacagtgatctgtacagacttggcaagcgtgggatatgtggtggtaagcatcggccatcagaatagcacgatgtataagcgtaaagatgggcgcctgtttaatgtatcaaaggatttttcggatgttattatggcgttttctgaagatccggagatgatggcgttggctggtaagatggcgatgcgtcctgacgatgaaactgccattgagatgtgccataacgtgtttacactgccgattcttggcaagttaacaaagtattgtgaattgcaggcggaagatgtaaggtatgcagccgattatcttgtcaaactggactctggagagctgaattccatctttaaggacagattatttctctgttgatcgtgctgcgcatttagattactgcgacatcgtgtttaccagtgtgaatgaggaacttagaggcgaacggaatgccacggagatgcgaaatcttgttacagactatacgaagaacttttttgatcattacatcctgcagaaagctgcaagtgtggaaagtctggcatacgatggcgtggacttgatcaagaagaccagcaacaagtgacataacagatgaaaatactcaaactgaaaaacctttataaccaatttaatttattaaggacgtagaggttttttaatattaccttactaaaaggggaagctgttagaatatatggatccacttttatattctcttcacaatttctagtttacataatatatattctaggaagttataaagagaaatgaattataagtctcatgaaccaagtatactttagttattgagacaaagaagggaaatttataactgcaataatcgcacattgtgttattgcgttacacgtataaaaatgtttacagcggctgaaaaacctaacgcaaaagcaagcttgaacagccgccagccagagcactgccacgaaataaaatccggctgtgagcccagccaatcatttttaaaaaaatcccgaaaccaaggtcccccgaaaataccgagtgcataaagcgcctggtatgccccatcgatgttgctctcatgcccgccagaacagactcaatcgacattccaatatgccgtcgtgaagccaaacattgtcgtaaaaatcaccatgccatgggctaaaatggacaaaaacaagattttcagcagggacatctgcccggctgccttcatcatgccgctcaatgtaggaatctttgcatgagaaaaagccgcctaatgaacagacggctctgcagcttgttattccattcggttacctgcggaagcatgagtgatccgataatgcacagttaaaaatttcagtccgaacagccacatatgatgaacggccttcaggcttgtttcgctctgggctgaaataagaaatgtctctgccagcggaagatgacacgtcccccatttcgtctgcagataaatcccttcatctcccgctccgctttttcgccgtctgcttgtcaaaacaagattctgcttacgcgcataaggctttaaaatgcccgtcatttggccgtacggcagcggaagagcgatattcatgtatccttccccttttgccctgtacgctgaatacagcgcagtaaaaacggtttcctgcttttcatttgttctgatccacgcacggacattttttctgccgtctttgtcagagtcaactcctataatatcactgtgcatgatataccaatccggattcatggacaaatgaatctgccccgctcttctgctgaacggctcgtacacgcgcgcgaacggacgaaaccaaccgctccacgttactttcgccatgatgtcataatcaattgtcttttcataaaaggaaataacggccggcgccagcttttcagttgaaaagtcttcagaatgcagttctctcagctgatcctgaaggccggtataatggatgtcatttgctgcatgaatgtcagtcaaaaaatctttgcctatcgttcccttcccgtaaattctgctgaacgttctttcactgttctcatcgaacggtctaggattttctattctccaccccgccaaagccggcaggataacgccgaatgcattgacggccccatgaatccaaatcatctggctgatcgtgagcgttgcctctgcgcggtagacaccgtacgaatatatcaaagaaaaagcaattgtgatcattaacacagccgaagaactcctgatcaagatcctgcctgttttcgtaacaaacggcgccttaaagacgagatatgcatttacatacagacccgcaagatacagagcgacagcaatcacatcaagtgtctttgaaaatgtaatccccaaggcaattaggaccggcgaaatcaaaataatgaccgtgctccaccggtaaagtccgcgtttctcccgtatgatcctgccgagcaatccgttaaagatcggaatgagaaaagcggaatagtgaaagtgcaccgccgtcagcagaacgataagcgggccgaaattcaggacgggaatctcaaggacatatgcgaagaaccagaatccgcccccggccaaataaatgaaacccgccataactgacatctcttctgttctgtgaatatttgttttcatcagccggcggacagcatacagtgccagtccaagcgtataaatgaaccacacaaaggcaaaaaagctgaagcctgtgacaagcgcaagcgccgcacatatagcggcaacaggataactccgtaaccacacattctctaaggtctttgacggccgaaaagcaaagcagaatacagcgggaacgaaaaaaagcacggaaaataaaacaaacgtctcagccgctgatatatgcggagcttcagccgccgcaaatcccaaaaagcaaacaacgcttaccatgagatgacgcttcagcatgtttctccctctgtttcccggaaagtcccccggtaagagaaaagcgtgccgagtatccggtttttcacatgaacctttatgctgaagcaattcatttcctcatcataagcctcataaacggttgaattcccgcacagccatgccggaagcgggattttctttccgcctatcaggagccactgccttccggatgtaataacaagccctccgtctgaagacgcttctaaatgcagttcagacagtaggatgtgaggtttgccgaagtaatcaagaattctgttttcccgctcatcatattccatgaccgcatcaaaaaaacgcgttttgcctttaaagaaaaaggtacgattccattccacgccattttgcctgtttttgttttcgatagtaaaagggatatcgtttcccctctctgagaaaaaacatctgaaaaaaacaccggtctttaaaagcattctgacaagaaaagaacctccctttatttctgacataacgccttctccgcaaaacgtgcgtgatccgtcaaatctgtaccgtttctgcagcatcgggtgcagtgattgataatgagtaatcgttttttcatacattgaatccgtcatttcacttctctctttcgttttgtatgccaggcgctcggcagcttgagcttaagaatcataccggctatcgtaaggactcctaatgagatcaagaatccgccgccggaatataacagtgccgttacacaaaagaagactgactgcccggcgtgaatcagccactttctccgcatgggaagcagccataatacccctaaccctgtctccaaggctcccctcacgatctctgcatcggcacagccatcatgaaagccttgaaaaaaccaatacagactgaatacgaggcacatacagacatagacaaatccgaaacggaccgatatcttcggatgtctgttttgttctatccaaagccgcaacgcatcaaagctccatgcggtagcccagcttagcagaggacgaaataaaaaccggtctatccaacttcccggcagaccgcgggccgtttcatattgatattgagtcaaaaatgaggtttgtccgttatcccgctctatatacttccagtagcccctgccttcttttataagtgacagcggatgatcagaggcaaaagcgagcgaagacactctttctgacaagcgaggccttatgtcacctattgattcgcccgtgccggataccttcagcccaaaaccgattcgtgtttcatatagaaatctctgcggttcatctggcagcctatgaagatatgtaatgtcagaaaaacgcagatcccattctttatgaagatgcgggttttgcgtatattcccaaagcgtttctatatcagatgcaatattgatttcgacatatatcggcttctgtttcatgctccctcctcttcccttcttttgtaaacaattcctatattatcataggaacagatcaagcaggagaacgaaaaggccatcccgttatcggcaggacagcctcagtggctttgatgacttatgaataaggtatcgtgtcttttttatcttcagaaactgtttgaatgataatcggacgcacaaaacggattaccgcagccgaggccaaaacagctaatccgcctgcaagcaaaaacgcccacgagaatgatccgcttttatccgcgataaagccggttaaagcaggcccgataataccggccgtgtttgcaagaaaatgcataaagccgccgactgacccgacattcctttgatcaaccacatcatgaatcaccgcccaatagatagagcccgttatatataaaaagaagactgataaagcaacgagaataacggcacttacggcagtggtaacaagtccggcaaatccgatcagtacagcggaagcgaacaggcaagtgacaagaatgactttccgtgagaacaaaaccccttttccggcggtttttttgtatacataatcagaaatcattccgcctgccgccaaaccgataaatccaagaatccagggaataacagtcaccacgctcataaattcaatacttaaaccgcgttctttcaccagatagctcggaaaccatgttaggaagaaaaataagatgtaattgtaggcgaaaaaggcaaaagccgtgaagagaaccgttttttgttttaaataaaaggtcatcgggatatgctgctcatgcgattgaaccgccgctttcattgccggggtgtcttccgtctgtgccggccgttctttgacaaatttaaaccagataaacgcccagactaaaccgacgatcatgatcaggacaaaggaaaccttccagctgaatgccacagcaatcatcccgacaatcgggccggaaatcgctccgccgagcggcgtgccgctgtttgtcaggccgatgaccgtggcgcgctgagacggaggaaaccaattgttgaccattttgcttatggcagccgacagcggcccctcgcccataccgaataaaacacggataatcaaaagacttacaaatccgaaagcaagcgcaaccgccccgctgaaaagagaccaaacgatcatcgccgtacacaatgtcaatttagccccgtaccggtcagatgcaacaccgccgaggaagttacacacagcgtatccgacagaaaaactgctgaaaatcagccccatttgggttgcagacaatgtgatatcctgctgtatgaacggtgctgcaatagatagcgctgagcggtctaaatagttaatcaccccggctgaaaataaaagaagaataatagggaatctatcctttgagaacataaaatccctccctcttatttcataaattaaattgccggagtaaaccggtttatgtaatgaaaccggttatccggattgccttggaagaagcgccggtttatagcggtgaatccgtttttcaccgctatctttttcttgtatctggcaaagaagaaggcttcccgcttttcgcgccatttctgccgcaggctggacgatcgtcgtaatcggaggagtaaaaaaacctgcaaaaggaacttcatcaattccgatgacggctgccttatccgggattgtcatatcatgctccttcatatacttcagcacctcaacaagaacgatatcgtttgccgccaatatcgctttcggaggctcctgaagtgagaacagctctgacaaaacattagaaatatcagccgcatcggctgttttgatatattcgttccgcaccatcattccgtggcggtcaagcgcctttttatacccttcaatccgttctaccctcggactgatttcccgaataatggacgtcgtaataatcgcgattctcttaatgccgctctcgataaaccggtcaacggcaagaccggctgcatgatggttatcaagcatcactgtcggaatcccgagttcttcaatggttctgtccataaacacgaccggaaacgtatcgcgtttcatcttttcatataaggagagattttcgcccgtcggaaaaataataattccgtccacctgcttggccctgagcatttcaatatatttcttttctttttccggttcatcatccgcattgcagacaataatatgaaatccttgttcatgaaaatagtcttccaccgccctgatgacctgagtggaaaaggtgtgaagaatattagccaccaccacacctaccgtaaatgttgatttctgttttaagctgcgggcgacgaaattcggctgatagttcagctcatgaatggccgcttctattttttgtttcgttttctcgctcatatagtcatagcgctgatttaaaaattgagatacggtgcttttagatacgtttgcatatttcgccacatcagaaattgtaatggttttcatagactcatccccgtctgtcttcatttttcactagtataagtcagaagtaaatagtttacaatctgacagggaactggattctgtcacactcccgaataagccataaaacctccgtcgacgggaacggtgaccccggtgataaagcctgagcatgaatcatccgaaagccacaggagcgttcccagaaggtcttccggtttcccgaaacgtttcatcggtgtatgtgccataatcttattggatcggtctgtcagacttccatcttcctgtaataacaactcacggttttgcgcagtcaaaaagaaacccggagcgatggcattcacccgcagcccttttttcgcgaaatgaacagccatccacatcgtaaaattctgaaccgccgccttagccgcgctgtaggcaggcacctttgtcatcggtgtatacgcactcatagaagaaatattaataatcgcgggacattccgccttcaaaaggtcttttccaaacacttgcgatgccagaaatgcaccggtaaagttgcttgaaaacacgctggaaaaccccgtttcgtccatatcaaaaaatgatgggccctgctcatcctcttcatacgtctcattggcagtgatcgcatcagcgtggtttcccccggctccgttaattaaaagattgacagaaccgaaccggctgataatctcgtcttttgccttttcgagcgaatcacgggctgaaacatcagccggtacagaaaccgcggttcctccagcgtcagcaatctcgcccgccgcacgctctgctttatcagcattccggctgacgatcgcaattttcatcccctgccgtgaaagctcctttgccattgctgaacagagaacaccgctcccgcctgttatgacagcggttcttcctgataaacgttcatgaatcggtctcatctcttcacctctttctcatgagacgagaacgcatcccacagtccgctcaagtacataattcctaaggcacgatcatataaaccatagcccggccggcattgttcgccccagatatgacggccgtgatcaggccgtacatatcctttgtagccttggccgtgcaattcttttaccacaccggtaatatcaatggacccatcactggtaagatgcgaagtttccgtaaaatcaccgttatcgcagattttcacatttcgtatatgggcaaacggcgcagctcccgcacagtgtttggcgatcttcaccatatcattggcgggatccgctcccatcgaacccgtgcacaacgtaatacagttggcgggtgaatctgaaatctctcgcagcttttcataacttttctcaccggtgataatacggggcaggccaaaaattgaccaaggcggatcatccggatgaatggccatttgaatgccgtgttcctccgctacaggaaggatttcatgtaaaaagaattctagattggcccaaagctgtttttcaccgaccgtttgataggcttcaaacagttccttgatccgggccattttctccggctcccacccgggaagcgtcaaatcagaagattcttcaaccgtgcggatcagttcttccggagggagactttccactttcgctttttcaaaaaacaaagcagttgacccatcctccagtgcgcggaacatatcagtacgcgtccagtcaaaaatcggcatgaaattgtaacagatgactttcacgccgaattcggacagattgcgaatggtctgtttatagtgctcaatatattgtccgcgttcttcatggccgagtttaatggcttcatgaacattcacgctttccacgacctctgcatgaaacccataggattgaatgaatctgacttccgcttcaatgtcctccttttcccatacttcgcccgcgggcttctggtgaagagcccagacgatgcctttgaccccgggaatttgtctgacatgttcaagcgtcaccgtatcattaccttggccgtaccagcgaaacgtgatattcatgttacacccccgtatattcgttttttcggcagacgtattctttgctgagggatacggcagcttcatagccgcccttttgatatgcttttgtcaagtcgcttcccactccgaccgcgaccgctccggcagaaagccagtcattcatgctgtttaatgagatacccccggtcggcataatgcggacattcggcagagggccgttgaccgacttgataaatgagggattaaacgaattagcggggaacagctttaccacatcacatccggcttcgagcgccaaagccatatcagacacgctcatgcatcccggcagatacggtacgctgtactggttgcatagagatgctatctcttttacaaaatgagagctgacgataaatgaggcgcctgataaaatggcgtgtctcgctgtttcggtatccattacagaaccggctccaagaagaatatcttgatgccggagttccttaaagacatcttccacttcaggagttgtgtatgtaagctcaatggcgctgatacctcctgaaatggccgcttttgaaacttcaagcgcctcttggctgttttgtccccttatgacagccaccacttgtgcatgcagaagtttttcgtaaatggcgtacttaggcagcattctcgctcctcctttaatcaaacgtaatgattgcttttcccaccttgcccgggtgctgttcgatcaactgaaatgctcgatggacgtcatctgctgaaaatgtatgtgtaataagaccgccgtgcgttaacaggcctttattcagtaagtctgtaatgtacggaaactgattcgtctgcaatcttgaaccggtgatcgtgacttccttttttgtgatcggaagctgagaaatgccggcagtcctctcatcaaaaccaagcacaaccacatgaccggccggagacactgcgtcaattgacgtttcaaacgttgaggggagacagacggcatcaatgacgacattagcgccttcattttttgtccattcgttcacccgcaaaacgggatcttctttttgcgcgttgacggtaacatccgcaccgtttttttcagcgaaggccaagcgttcatcattcaagtcggttatcatgacggaagcgcctttgaactttgccatttttaatatgcagattccgatcggccccgctccttgaatcaaaacggtatcttccttctcgacacggcctctccaaacggcctgggcgccgatcgtatatggttctgccatgaccgcttcctcccagggcagatcgggcgaaacagcatacagctgcttttccggaagcacgatatattcccgcatcccgccatcttcatgaacgccgaacgccgaaagcgctttgcagacgttcggacgtcctttccggcaggcatagcatgttccgcaataagatatcggttcaatcactacccggtcacccggcttgaaacgccggacatgagaaccggtctttgcgacttcccctgtgacttcatgtccgattactctcggcagggacgctaacggatttgtcccatgataaatatgcaaatctgatccgcaaattccgacccgcttcaccttgacaagaacatcatccgcgtggacaacagacggtttctcacattccgtcaccatcagatcaaatgctttccgtacttgaaccgctttcattttttcacccgctttttaagttgtgcttgctaccgttcaatcacagtctctttgtttacaaatgacaaaacctcttctaggcagggaagcccttcattgtcaccggaaactgtggtgacgagcgcaccgactgcatttgcaaactccagacgtttttccggttcaaaaccatgtagataactgtacaggtagccggcattaaagccgtcacccgcccctaccgtgtcgacaggcgcaaccgggaaagcctctttgtgaacccacttatgatcatgatacagcgcagaacccgcttcaccgtcttttatgacaagctgactgattgaatagctctctgcaaaccgggctaatgcttcattttctcctatacctgtcagctgtttcatttcgtcccggcccgccagaagaatatcagtatgcggaaagatttgatgaaatgccgcacgtgcctcctcaatcgtccacagcttcagcctgatattcggatcaaaagatacgggaatctttcttgctttggcgatagaaagcaccctttcagcaatttcaagatttttcttatcaagcgcgaggaacacaccggtaagatgaacgatgtgaatgccgtcaaacatattctcagttatatcttccggtgcaagagtcagaattggtgaattgaaacgataataaaacgtcttgcctgaaccgtcatttctgatctctttgacatttaaagatgtaggaaagccttcaacaaaggagacgtcagtcacatcaattccttctcctttggcaaactgataaatcactctgccgaactcatccttccccagtctgctgacccactttgagtgcaggttcaatctggcgcatgcaatcgcaaaattcagttcagctcctcctgcttttcgttcaaaatgggtaacaaaacgcaaaggtcctgtgcttgcgggatttaaggtgatcatcgcatcaccgatcgtaaaaatgccataatcagaagccacatcaatactcctttcctttaagactaaatcggtttggtaaaccggtttagttaaactttatatgaaagcacttacatatacaagagaaaaatacaataaattcaaaaaaatctgttttcagtaaaaataacccggtttttcacataaaaaaccccctcacaacaaaatgtaagggggttttttgaaaattgtatgcatgttcctcagttagcagtcttacgttcagggcttgtaccttcttcttccgcccatgtttcaatatgcttgagctccggagtattctcggctttgaatacgggatcaagaccttttttgcgctgagcggcataatccttatagatcttgtaggctacattactcagcagtaaaattgccactaagttaatgagagccaagagacccataaacaagtttgccatgtcccagacgatctggaagtcagccaaacatccgtataccaccatcactacgacgaatacgcggtaaatattaagccatgttttgcttgttttaataaattcaatattcgtttcaccatagtaatagttgccgacgactgagctgaatgcgaataaaaacatcgcaatcgcaataaatgtcggcgcccatccgccgagatggtgctgcagtgcggcttgcgtcacttggatgccgtcgcctttaggcgtaacgctgtacaataaaatgataaaagcagtcgatgtacaaacgataaacgtatcaaagaacacgccgagggtctgaattaatccctgcttagccggatgcgacacatgtgcagctgctgcggcattcggcgcgcttcccattcccgcttcgtttgaaaacaggccgcgctgcgctccgataataatgatgcttcctaagcttccgccgacgatctgctcaagaccgaacgcatttttcacaatcgtaacaagcagctcaggtaccgccgaaatatttacaatcacgacatacagcgcgatcagaatatacattcccgccataaccggaacgattaattgcgagacggaaacaacacgcttcagaccgccgaatataatgaaagccgttaatacagctaaaatgattgcgataactgttttattcacatggaatgcttcgtcaaacgccacagaaatcgtatttgactgcaccgcgttaaagataagtccgaaagaaacggtaatcaatacggcgaataaaataccgagccagcgggcgcccagtccctttgccatgtaatatgccggaccgccgcggaattcgtcaccggaacgcactttatacagctgcgccaaggtgctttccacaaagctggaagccataccgacaatcgctacgatccacatccaaaatactgcgccgggaccgcctgttgcaatcgccagcgcgacgccggtcaagtttccggttccgacacgagaagcggctgagataaagaatgcctgcattgaagacactcctttatttccttgcggcttctccccgacgattctgaacatttcaaaaaagtactggaattgaataaagcgaaaacggaacgtaaagtacaatccgatcccgactaaaatataaacaagatacttccaaataaaatcatttggaacatttatgatttcactgatgaaagcctccatgtttaacctcccttttacatatcttttactgtcatttttgctgtatatgttagatcttttaacacaacgggtattattatatcacaacaacagtggttgagaagtttttttaagaaaatgtttcggtttcttcatcacatcttttgctgtcatgccccgttttttatcttacagcccgaaaaatgttgtcacgtcataaggaatgcgtgcatatcataacaaataggtctttaagaaaaaagagatgaaaagatggatggaatggtatatacttaaccaggataataattttttaaatttaataaatgtgtttactttacatttaaattagggtattataataaaaatattcagacttatgaagggaggagaacatttgaaaaaaatcttgtttttaaaagcttctattttatttttagcgattgcaagctttcatttgctctccattccccatgcgtttgataccgctcatcattttaaagcggtagccgaccagcaggaaatgcacgaaatgaaggccggccaaaatgctgatgatgagaaaaaatcgctgacggactcatatatcttgacggcgctttttgccgcttctgtctcactgatcgtgatatcagacaggagacgccccgcttcccggagaagacagcgaaagaaaagctttttaatcgctaaattttatcagtcctcgtatttcgatgagcttcatgttcaacatcgcctatctatgtaacataaaatgaggaggttgttaaacatgttgtttatcttacgaatggtgattttagggttgttttcattcactgcattgaatttatttgtatggcagggaatcgaagtcattcacgctatcactgacttattcggcagccatgaaagctaaatagtaaaacctccgctcaatgagcggaggttttttattttatttttactcttaaacaccgtatgcagggatacgccatacatctgttaccggccctgtctcatcttcatcggtaaagaaggagccgttgctgtatcggtcattcgcccgcaaggacttcacggcgatttcgattctctcgcctttttctgtttccgcagcgatcatgtcggctaaagcgcacgcaaatacgccgactgcccgatgcgggttctttttaagctcacgcagcatgatgacaccgcgtttcgccctggatgttttttcgaattcagataggttcatccgtttgattgctccccgctgtgtgacgaggacaagcgaatctgtttcatgcaggatttgccctgatacgacggtatcaccgtcttttaaatttatgccctttacgccggccgcacgggcaccgactacatttacttcatcttcaccgaaccataaaccgtacccgaggcgggtggcgataaacagctggctgccgccgtctgtgacatgaacatcaatcagctcatcatcccctttaaggttaagggcaacaagcgctttcgagtaacgctgcgctttgtaatgcgtcatttcagttctcttcaccataccgtttttcgtcatgaacaataaatatgaagatggatcaaattcttttaccggtatagctttcacgatggtttcatcacggtcaatcgtgatgatgttcgttacgtgctgccccatgtctttccacctgatatcgggaagctggtgaaccggacaataaacatagcttcccttattggtaaagagcagaagaacatccgttgtattcatttcaaattggtgaatcagcctgtcagtatccttcataccgaaatcctggccgttagaagcggcaaatgaccgctggcttgttcgttttacatagccgtcttttgtgactgtcacatatacgtcctcagaggcaaccatgacttcaagattgattttaatttcctcaatcttttcttcaatgacagaccgtctgctgtcagcataggtctttttcaattttttcaggctgcttgtaatgacttttaacagctttttatcatgacttaaaatggcttcgagctcctgaattttcttgctgagctcttccgcttcctcttttagcgccgtaatatccgtgtttgtcagacgatacagctgcaaggatacgatcgcttcggcttgcggctccgtaaatgcgaatttagaaattaagttttgtttcgcatctttcttgtcgctgcttgcccggatgaccgctatgacctcatctaacacggacagtgccttcatcagtccttcaacgatgtgatgccgctcttttgctttttgtaattcaaagacggagcggtttgtcaccacttccttctgatgggaaatatacgcatccaggatggccgtaagactcatcagcatcggccggcggttatgtatggcgaccatattaaagttatatgttgtctgcagatcagtgtttttatataagaaattcaggatgccttttgcatcggcttctttctttaactcaacgaccacccgaagccccgtgcggtcagtttcatctctgacttcagaaataccttcgacttttttgtctatgcggtattcgtccattttcttaacgagattggctttgtttacttcaaacggaatttctgtaatgacgatctgctcccgtccgcctcttacggattccacttcagccttgccgcggataataattttgcctttaccggtttcataagccttccgaatgccgtcgactccttgaataatgcctcctgtcggaaagtcaggccctttaatcacctgcatcaagtcatcgacggtgcaatccggagattcaatccgtttaatgacggcatcaatgacctcacccagatgatgagggggaatatcagtcgcatagcccgctgaaatcccggttgatccgttaacaagcaagttagggaacatggcgggcaaaacaaccggctctttactggtgtcatcaaagttcggaacgaattcaaccgtatttttatcaatatcacgcaaaagctctgacgcgatagaagataatctcgcttccgtataacgcatggcagccggcggatcaccgtcaatgcttccgttgttgccgtgcatctcaatcagcacattccgcactttccaatcctggctcatccgcaccatcgcttcataaacggagctgtcaccgtgcggatgataattaccgataacgtttccgaccgttttcgccgctttacggaaatttttatcgaatgtatttccgtctgcgtgcatggcgtataaaattctccgctgcaccggctttaaaccgtcacgagcgtcgggcagcgccctgtcttgaataatatatttactgtagcgtccgaaacggtcgccgattacttcttctaacggtaaatcatgaaataattctggctgtgccactattaaacctcctcagcgaccgacaagttttcattttccaaaatattgctttcctcatctaatccgaaggcaacattcttttcaatccattttcttctcggttctactttgtctcccattaatgtcgttacacggcgctctacccgtgccgcatcgtcgatcttgactctgacgagcgttcgcgattcgggattcatcgtcgtttcccagagctggtctgcgttcatttctcccagacctttatagcgctggatggtatatcctttgccgactttctttaaaacgccgtccatttcttcgtcggaccaagcatattcaataatctctttcttgccgcttcctttgctcactttgtaaagaggcggaagggcgatgaaaacttttccgtgctcgattaaaggtttcatatagcggtagaaaaacgttaacagcaagacttgaatgtgcgcgccgtcggtatccgcgtccgtcatgatgatgatcttgtcatagttgatgtcctctatatcaaaatctgcgccgactcctccgccgatcgcatgaataatcgtattgatttcttcatttttgaagatgtctgctagctttgctttctctgtgttgatgacctttccgcgaaggggcagcacggcttggaatttccggtctcttccctgttttgcagaacctccagcagagtctccctccaccagatacaattcattcttcgccggatttctggaaccggccggtgtaagttttccgctcagcgtcgcttctgattttttgcgctttttgccgcttctcgcttcttctctcgctttacgggccgcttcacgggcctggcttgctttaatcgcttttttgacaagcagggttgccgtatcgcggttttcttccaagaaataagcaagattctcagaaatgacggcatcagcggcggatctcgcctcacttgtgccgagcttcccttttgtctggccttcaaattgcagcagttcctccgggatacggacggaaatgattgcggacaaaccttccctgatatcggcgccttcaaggttcttgtctttctcttttaaaagggcgacctttcgcgcatactcgttaaacgctcttgtcattgccgttttggctcctgattcgtgggtgccgccgtcctttgttctgacgttattaacgaatgacagcatattttctgaatacccgtcattaaactgaaacgcgaaatcgacttcaatgtcatgatgctcgccttcaaaggacaccacttcgcataaagcgtctttttcctcgtttaaataagcgacaaatgcttcaattccgttctcataataaaatacttcttttacgccgttccgttcatcaattaattctattttcaaaccttttaacaagaaagccgattcgcgcagacgttctgacagcgtgtcaaaattataaaccgttgcgctgaacattgacggatcaggtttaaaatgggtaagcgttcccgtttttttggtcgttccgattttttcaagtgaagtcacgggcttgccgccgttttcaaaccgctgtttataaacatatccgtcacgctcaatagtaactgtcagccactccgataatgcgtttacgacagatgcgccgacaccatgcagaccgccgcttgttttatagccgccctgtccgaatttccccccggcatgcagcacggtgaaaataacttccggcgtcggctttccgagcttatgcatcccggtcggcattccgcgtcctctatcctgaacggagatgctgttgtccttatgtatcgttacgataatatgatctccgtagccggcaagaacttcatcgacggaattgtcgacgatctcatataccagatggtgcaggccgcgtgcgtccgtcgaaccgatgtacattcccggtcgttttctgacggcttccaggccttcaagcacctgtatggcatcttcgttgtaatcaaattgctgttttctagccaaacgtacaaacccctttcaaaaaacctgctcttaatcattctcttttttaaatgttttcatgtctttgtttttcagtatgcgcaagcttcggtccaattctcctcggactcacaattataaccaatatgcttgatttcgcaacatatttaagcgaatggctcgttttttaggccgcaagacatacattcgaacggcttttcatctttttggtgcccttttcggcagataagaacatgagttcgctttctattatatagctttatgccggccatcgcaaacagactgcaaacccctgtataaaggggtttctaaaaaagctgttcatgctttattgtatctgtttcatcatcatacgcaaagagtattctttcaataaaaaagcaaaaacccctgatttgccaaggatttttgccttttttgttcctattttataacagcgcgggcgacttttatacataaatccattacagccgtccgtcctttgtctgtaatcatgcgatacgcttcttcatttgcaagaccctgctgcgcccaaaaaacgggagcgtccgtctgtaaaaattcttcagcaacgccgggaagctgctcagagcgtctgaacacattcacgatatcaatcggtccctccacgtcttttaatgaagcaacggctttaacgccaagcgcctcatcaatcgttgggttgacgggaataatttcatacccttcatcctgcatcgctttggaaaccatgtaagaagtccggtcgggacggtctgacagcccgacgactgcgatccgtttgctccggtccagaatttctttaatctctgattttgaaggattttgcatctttaccatctccttttgatatattgtacatgaccgcttcgccggaatcaaaaaaagcgatttgtcagcttaattctcaaaaaacttgtcatcagacggtaacaactcgtgttaaaatagagtgaagggacattgaaaaggagaaatgtagatgttgattgctttattgattattttggcctatgcaataggcagcatcccgtcaggtttagtcgtaggcaaacttgcgaaagggatcgatattagagaacacggaagcggcaatttgggcgctacaaatgcttttcgcacgcttggcgttaaagcgggatctgtcgtcgtcgcagccgatattttaaaaggcaccctggccgcggcgctcccatatttactgcacgtccccattcatcctcttctcgcaggggtggcagcagtgatcggccatgtattccccgtgttcgcaaagtttaagggaggcaaagccgtagccacatcagggggcgtcctgctgttttatgctccgctgttattcgttacgatggttgcagtatttttcgtatttttattccttacgaaatttgtttctctgtcttcaatgttaacagggatttatacgattatttactgtctgtttgtaaaagacccttatttattaatcgtagtgacgctcttgaccgcgtttgttatctacagacacagggcaaacatcaaacggattataaacaaaacagaaccgaagatcaaatggttttgatgaaacttcaattttgacatcaaaatgccatattcgtttataatagagataatttctttatatgagaaacaaaaagggagtgttccggatgaacatgaaagtaacgaaaggcgcgctggattggtacaaagaagagctcgatctggaaacaggcgaccatgtccgtttctttgtccgttacgggggatgcagcaacgttcagaaaggcttttctctcggcattttaaaagacctgccgatgaacatcggcaccagcacggaagttgaaggcattaccttttttattgaagaaagcgacttatggtactttgataatcacgatttgtcagtcacatattcagatcaggcagaagagccggtatttgattacgtgtaaaaaaaagaacgcagcggatgcgttctttttttttacagcctgaacctttttaggtgatcagtcagacgttctttttctaatatgcttctttgcgtttctccgagcaggtcaaagtggggaaattcatttttatggtgaatccactccggcttcagcccgtactccgctccccatctgatcagtttattgagatcgcttgaaccggccttcgtcacggtcttagcctccggaaagcggtcgtccagccagtaatgcgttaaaaaagcgattttcccttccgatacatcccgcttccatctttccagttccttacgcgtaattccaaatgccataagtgcagccgctccttatttttttgccttttcgtaagcggcatgccaatcaggaaaagccttgcgaaactgaatcggtttgaagctctctttatcaacgcatatatgagaggatgtcgctttgatggcaagttcttgatccggattatagatgtggtagccgtaaacggttttaaatccgttatattcttcaatccaagtatgtacgacagccgtttcaccgtagcggagcggctttttataagaaatgctgatatccaatacaggggacagcactcctctatcttccatatccttgtaaaggaatccgagttccttaatcagcgccgttctgccgacctccatccagactaagtaattggcatgatagacgatgcccatttgatctgtttccgcataacgcacttctatttctttttttgacacatgcaacgttctctgctccctttttatcagattagccccattttatcacaacgagccggaaagagaaaaaaaccaggtttccctggtttttattatgattgatagccgttttctcttgcagccgattcatcctgaatttcactgcggaacgattcaatgctttcattgcgtctggcattcttttcttgaatgcgctgtttttcctcatctgtcgcaaattccattgattctttcgcttcttctatattttcaattgtattctgcaccatatcctgcagcttttcaacgttatcggaacggtcatccggattcggtttttgatcattgtttgtcataatgtctgctctcctttgatgatgttattcgcctttcgtctgcatgacaatcggatgtccgtttgacttgtcatgaaacttttcccctttgttgcgtttatatttaacgggttttgtccctaagtggctcggagcgtattgcggctggccgtctttcttgtttatgcccatgttcatccctccttaagagtatattttgcaaaaggaggtgcaaacatgactgcaaattaaaggttatttttgtttgaaccgctgctccagcttttcttcaagctgattcaaatattccgtattggtcatcagctcacgtttattttccataaccaattcatgaaaagaacgttttcgcatttttttcaatcttctcacctccgtgttttcattcattttttccaatttttcaaaacctaagccctttacaataaaaaaactgaacctctatttgagatccagtttttctttcatttctttttttgtcatcgtgcctacgcgaatatgctgaatggttcctttttcgtctaatatgtatgttgtcggataagaaagcacgttgaaatccccgttaattccgcttttgtcaatcagaataggaaaggtcagctgataatgatcagcaaatgatttcacagcctgtatatttttttcagaggacgtaaaattaacagctgctaccgcaatatcaggatattctttctgcagctcctgcatatcgggcatttccattcggcacggcttgcaccacgtcgcccagaaattaaggagcactttttttcctttataatcagaaagggagatactttttcctgacaatgtatcaagtgtaaagtcaggggctttcatcccttcttctgtcccttctttcggacttttttgcacggaataaatgttccagcccgcatatactaacaacccgataagtaacattccgcccagccatttcgcaagcatcttaaggcctcccgcataaaaagagagaaagcagactgctttctctcctttgttcattctgctactgtttcattttatcgcgaagcaccatttgtaaaatgccgccgtggcgatagtaatcaatttccacttcactgtcaaaacggacaacgacttcaaacgtttttaccgtaccgtcttcactgattgctctgacagtcagcaagtcgcgcggacgtacagattcatcaacatccacctcgatgacttccttaccggttaagccgagtgtatccgcgttttcaccttgtttgaactggagcggcagcacacccatgaagacgaggttgcttctgtgaattctttcaaagctttcggcaatgactgttctgatgccgagcaggtttgttccttttgcagcccagtcacgtgaagagcccattccgtaatcttttccggccaggacgacaagacccgttttatcttctttataccgcatgcaggcatcataaatagatgtcacttccccggtaggccaatgtgttgtgtatccgccttctgtacccggtgcgatttggtttttaatgcggatattggcgaatgttcctctcatcatgacttcatggtttcctcggcgtgagccgtaagagttaaagtcacgaggagaaacgcctttttcctgcagatatttgcccgccggtgtgtcttttccgatcgctccggccggagaaatatggtcagtcgtcacggaatcgccgaatttgccgacaacgcgaagtcctcttaaaggctcaacttttcccggctctacagacatttcctcaaagaatggcgggttttgaatgtaagtggaatcctggtcccacttatacagcgcttcatccgtcgtttcgatttcgttccagcgctggttgtcgtcaaataccgtttcatactctttacggaataattccggcgtaacagtctgtttgacgagagaattgatttcatccatggacggccagatgtcatcgaaataaacattttgtccgtcatttccgacgccgatcggatccgttttcaggttgatgtttacagttcccgccaatgcgtatgcgacaacaagcggcggtgacgcaaggtagtttcctttgacaagcgggtggatccggccttcaaagtttctgttacccgacaggacagaagtgatcaggaggtcatttttagcaaccgcttcttcaatctctggagaaagcgggccggagttcccgatacatgtcgtacagccataccccacaaggttaaagccgagctccttcatgtaaggaagcagacctgagttgactaagtatccagtaacaaccttagaccccggtgcaagtgaagtcttcacataattcggcactttcaagcctaattctaccgcttttttggctaccaatccggcaccgattaatacataagggtttgatgtattcgtacagcttgtaatagcggcgattgcaatcgcccctgttttcataaccgcatcttcaccgctgttaagtttaaatgaaatttctttgttctcttcagcagcatccgctccgaatccttggttgccggccgggctgacaagatgttttttaaacgtttcctgcataacggaaagcgggattaaatcctgcggacgtttcgggcctgaaaggttcgcttcgatttttgacagatcaatttccacaacgtctgtaaaaatcggctcttccgcgtcaggcgtatagaataaaccgttgctgcggcagtatgcttccacaatatcgatctgctcttcttcacggccggtcagacgcaggtaagaaagtgcttcctcgtcaaccgggaagaatccgcaagtcgctccgtattccggcgccatattggcaatagtcgcccgatccgcaagcggaagctcagcaacaccaggaccgaagaattcaacaaatttattgactacgcctttttcacgcagcacttgagtgactttcagcgccaagtcagtcgccgtcgttccgttaggcaattttccgacaagtttcgcgccgatgacctcaggaacagggaaatatgaaggctggccgagcattcccgcttccgcttcaataccgccgacaccccagccgaggacgccgattccgttaatcattgttgtatgggaatcagttcccaccaaagtatcaggataggtcacaagttctccgtcttcctctttcgtatggacaacgcttgccaaaaactcaaggtttacctggtgaacgatacctgttgcaggcggaacggcctgataattgttaaacgctttctttgcccagcttaaaaatttataacgttctgcatttctttcgaattctaagtccatattaatggctaacgcatcttccgtaccggctttgtcaacttgtacggagtggtcaatgaccaggtcaaccggaatttcaggattgattttatcagggtctccgccgacagaggccatggcttttcttaaagatgccaggtcaactacggccggaacgccggtaaagtcctgcagaataacccgtgacggtttaaacggcacatcgatatcttttaattcagcagtaccccatcttgctaaattttcaacatgctcttttgtaatgacgcgtccgtctacctgacgcaaaacggattccaaaagaaccttaatagaataaggaagttttgaaacattgccgacccctgcgtcttccaatgcttttaatgaatagtagttgtatgttttcccatttgaagaaaatgtttttcttgcttggaaaacgtcttgtgttgcgactttttgctgatttgtcattctccaaaatcccccttcaatgatcaagatcgttctttagatgaatgttcacattccatcacaattttctcacaatttcatcttagtataaaatcatacataagtaaatatcaatgtttttattaaatacaataagatcgtcttatcagcatattttcggtaaattttgtccgattttccgcctcatacaacgggctgtaaagagccatattaatgttgaggtgatgatcatggtaaaacggaaagccaatcatgtaattaacggcatgaatgatgcgaaaagccaaggcaaaggcgcgggttatatagaaaatgaccagctcgtcctgacggaagaagaacggcagaacaataaaaaaagaaaaacaaaccaatagccggaacaccttaaaaaggaggctttaacatgacaaataaaaatacgagtaaagatatgcataaaaatgctccgaagggccataaccccggccagccggaaccgctgagcggaagcaaaaaagtgaaaaaccgcaaccatacaagacaaaaacataatacaagccacgatatgtaaaacagaccccggtgtctgtttttttgtgccattcacccatttaaagcttctgcatacgttatagcaaggctttttaatatggaggaatgcttccatgaatcactcaaaaaacgctgaagaatttgatgatacggaagaatggctgcggcagttttacgaggacccgtatgcttggtatgacgagacgctgccgatcgatctatatgaaacaagccgtcaatatatcgttgaagccgacctgacggccctgaagcaggtgcaggcgatcaccgtcactctttcgggaaatgagtttatgctctctgttaaaacgcttgaacggacattaaacaaacaaatggtgcttcctttttatctgaatgacaaacatattttcactgatttcaccaaccatattctgaccgtctccatgaacaaggagcctaatgagactcctgcctcattttcctttcaatttcctctataacataaaaaagccgctttcatccctcaatggaagcggcttttttgtccggtcatatcagtcatataccctcaaagtgaatctcccatggccaaatagcagaatcactatacgatagaatatgttctagcaaccgaattgactggacatctatcattttttctattctttttttcatgtgttcttctattctgtcttcgtttacaatatggttaaagtaaggaggagatagaacaatgctagaaggctggtttatgtggtttattttattttgggtcaacgtgatgatcggattgctgtctatcggcggattttttatgtttcgaaaatttttaaaacgcttaccgaaagaagacggccggtcagaactggattggcaggactattatattgaaaaaagcaggcacttatggaatgcgggtgacaaggcgtttttggatgaattggtcgctcccgtgccggagctctttcgggatgtagccaaagcgaaaatcgccggaaaaatcggtgaactttccttagcggaggaagctgaacaaataaaccgtgatttaatcatcaggggttacatactggccactcctaagcgtgatcatcaatttttaaaaaagcatctccgcgaaaaacagattgatcttactccttatcaggccctgctcaaataaaaaacctttccggcggacggaaaggttttaattcatctgaatattagcggtcttcagttcattcgaaagtttgcggtaagacataaacatcgcgatgcgccacggaacaatcattccgaaagccagaatccaaaacattccgcttaaagctccgtaatcaatcgtcgtgctcaaaatggatttcatagcgattctgataaccagcaaaccaatcaggataaacacaaacgcttttgaccgttttaaatagatttcattatttttaatctcaaatttagatgttttaatcagaaaaatagagaagatcacgcccagcgtaatggcctccaaaaattcttcgcccgtcactctgaaaatcggaaaaaggaacataagcgctcccgtactcatgaaaatcggcgggagaattatttttttaggtgaagcgggcttgtcggaggctttaatcctgacgatcatcacggaaattgccatggccgctgcaataacggatgaaattataatcatcatctttatcattcctttgcttgcacggagtttgatactatatactatactccaaaaacataaaaaaaaccaatttgaaaagagaacacgtttacgttcccgttacccggcctacggcctccagcactttagatgcttcaaacggtttaacgataaagtctttagcgcctaattcaatcgcttccagaacgatccgctgctgccgcatggcggtgcacatgatgatccgggctttcgggtcaaaagctaaaatatcctgcagcgcctgtataccgtttttgaccggcatggtaatatccattgtcaccaggtcgggacggattttttgatatactgccagggcttcctccccgtcagccgcttccccggccacagtgtaattcgccgattccagaatctctctgattttcaccctcatgaacttggcgtcatctacaactaaaactcgtgtcatattcccctccacatatttaacattaactagtcttattgtaccaaaaacgaaagggtatataatagttcaaaagttattaatccgttacagacccgtaaatcctccgaaaagatttgacagaacgatcagaatgtagctcatccagttaaaaaacagcataactccgatcagaatcataagaatgccgccgattttcatgataagcagctgatgcttgcgaatccaattcattctggtaataaaaaatgaaagaacaagaaaaggaatcgcaaaaccgagaacatataaaaacatatacggcactgctgaagaaggatttgtatttgccagcgaaaacacggctcctaaaataggcccgctgcacggcgaccagccggctgcaaacgcaagaccgatcagaaccgaaccgataaacccctccggacggcgcttaaagtgaatgcgccgctctttcatcatgaatttcggctgaaacacaccggcagtaatcagcccgaaaaggatcagcatgatagcgccaaactggcggatcgcttcatgatattgggtaaaaaaactgccgataaacgaagttccatatcccaatgcgataaaaatcacggagaagccaagcaaaaaacaaagtgtatgcacgaggccacgcttttgcagcatcaccttttctgttttcacctcgtccatactgacaccagttatgtaagataaaaaggcggggtacaacggcagacagcatggagaaatgaaagacagaaatccggccccaaacgtcagaaagtaattaaaactcacgatgacacactcccttcgagttatgacaaaatcatttcatttttttaacactttcccgagaaggattactttttatagaaaaagcttatataatttaatttgacatcgagatattatactccttcttatttgaaaaacagtataaatgtggatataataatagcgactcaggtgaaagatttatgtatgaaaggatatatccctgtgattagagagcatctattaaatgaaattgaaaaaaaacgggcagagctgcttaaaatcgtcatgacaaacggaatgacatcaaacattacgatagaactcagccaggagcttgaccaccttctcatacaataccaaaaagaactgcacaccggcagttggggtgaaacatgacgccaaaataaaaaaccctctccgggttttttatttttataaccatgtatctctatatcataatctgtacgtattatttcgcttgattattcatggctttcatcatttgattaattttcttttgagaaggtttcattcccatttgcatcatcatcatgcgtaacatttgttcattaataggcggattctttttcaaatagctcatcatatatttacgagcaataaaaaacccgagtgcaacacctatgagcaatgcgacaacgcccactaggatgccaacccataaagtcattttatttcctccttcatgttgtctagtttaaagtgtactaaaccaaaggctattatacaacatttacatctctttttcctcgtttttagacaaaatttctttccctgaccggatttaaccacccgtagcgccgtgtcttgaaatccattgcaagaaaacaggggctgattttacgcagaatctcaaagaaaatcgtttccgcctcataatctcccgaagccgcaatctcaattaaactgtctttcatcatgaaggtggcgcggcccttttctccgggcagtgtaagccggtaaatggaatccaaacggctgtaactcattcggtttaaatgcagctggagccgctgatgcatatgtatcaccggaatcggttccgttatatattgaacttgcttttctgtcatttgatattcctggggtgtcagatttgtccaatgatagtctcgaaacaactcaaacatagccgtttcccgcccgaagtagtggttcgcaaactcatcctttatcaggtgcgtatagtaatgacgttccatttcctcatccccttttacagcgcttcgttattgctatctattatacaaaaggagaaaagaaagaattgtctattactgttacgccgccccttctatttttgtcgcataaacaggaaaaagaggatgatttgactcatcctcttttgtctcgttatttgtttagaagttttttcacgcggtcaactacgttttctgcagtaaacccgtattctttcataattgtttctcccggagctgaagcaccgaaacggtcaattgcgagaacgtctccttcaagaccggtaaatttgccccatccgaagcttgaacccatttcgatcgcaagacgtttcgtcacattcggaggaagcacgctgtttttgtactcagccgattgtttttcaaagcggtcccagctcggcatgctgactacagatacgtgaatgttttcttcagccagtttcgcttgagcttcgatcgcaagtccgacttcagagcctgtcgctaaaagaagggcgtccggtgaatcggtttttgctttggaaacggtataagcccctttttccacgcccgcatacgcttcttcagcctgctgatcaatcgtcggcaggttttggcgtgtcaatacaagagctgtcggatgatcttggctttgaacggcaaccttccatgcagctgcggtttcatttccgtcagcaggtctgatcacagaaaggttaggaagtgcacgtaaagaagcaagctgctcaaccggttcgtgagtcggcccgtcttctcctacggcaatactgtcatgcgtgaatacataagtgacagggagtcccatcaatgatgccagacgaatggcaggtcttaaataatcagagaatacaaagaatgtgccgccgaatacgcggaggccgccgtgaagcgccattccgtttaatgcagcgcccatcgcaaattcacggacaccgaaccagaagtttttcccggcgtagtctttggccgtgaagtctcctccatttttgattgtcgttttatttgaacccgcaaggtcagcagatcccccgacaaagaaaggaattttcttggcgatcccgttcagtacctcacctgaagatgcgcgggaagcaaggctgctgcctttttcataaacgggaacttcctgatcccagtctttaggaagctcgccttttatgccgagtgacagctgttcagcaagctcaggatatttttctttataagccgcgaacagttcattccattcctgttcttttttcgagccggcttcttttacagcttgattgaaatgcccgtatacttcttccggaacataaaaatcttcttcaaacgtccaagcatacgcttcttttgtcagcttgctctcttctagtcctaacggagcgccgtgaacgccggatgtgcccgcacggtttggagaaccgaaaccgatcgtggttttcacttcaatcaaagtcggttttttatcattctggcgcgctttttcaattgcagccgtcaattcagcgatgttgtttccgtcctcaacataaagaacttcccagttcattgcttcaaaacgctgctttacattttcagagaaagaacggtctaaatcgccgtctaaggaaatgtcattagaatcgtataatacgatcaggcggcctaattcaagatggcctgcaagagaagcggcttcggaagaaatgccttccattaaatcgccgtctccgcaaatactgtatgtataatgatcaactacgttgaatgaatcacggttatatgtctcagccagatggcgttctgcaattgccattcccactgccattgcaatcccctgtccaagcggcccggtcgttgcgtctactccggctgtatgcccgaactccggatgtcccggtgttttgcttccccattgacggaactgtttcaagtcttcaatgctgagatcatatccgcttaaatgcagcatgctgtataaaagcattgaaccgtggcctgctgataaaacaaagcggtcgcggttaaaccagcccggattctgcggatttacattcataaatttcgtccacagcgtgtatgccatcggagcggctcccatcggcatgcccggatgtccggaattcgctttttcaattgcgtctatagatagtgtacgaatggtggcaactgatttcttttcaattgtatccattataatccccttccttattgttgtaccttttcatcataaagcgatgctgactttttctcaactctttcagcttaaatttgagataaacttgttgaaaattgtcgtaaagcacatcctgatattagtatatacgaaaaaagaatacgtattgccgtattctttctgtttagtgaagattatttttctgttgttctctttttaatttttcaggggtgacatcgttgccttccggatcaatcacttttacgctctttaacgtatttttcattgaggagcggaatcctttcaaatactcctggcgaagcttttgctgttcagctttttcctcatccgttatcatgtttgatttagctttttgagccaattcgttaattcttgcgattttttctttagaaatcataataagctcctttggtgagtgttgattatatactactaaaacgcagtcttttttacaactgatgcgcgtcagctgccttctgtgtctgcggtatattcctgaaaccgccggtgaaccgtggctttggacacgtcatagccgaatcctcttaaggtcgctgcgatttctgcaaaggtaagcttgttggctctcagcctgataatttccgaaaccggaacctcttttttttcttttccgctgttttcatgtctgtttttcagattccgttcaggcttgtagccgtttttcacggctcttttcattccccgccggattttcatattgtgaattttcctttgatattcctcaacaatactgacgatttcaagtaccatcgaatcagcttcggaaagctccagttcacctttatgagccgtcgtatatattttaacgttctccctgtaaatacaatgcaaaagcgcaatcttggcgtttcctcttcctaatctcgtttcgtcctgcaccaatatcgcgtcaatatgtgattttttaatttcatcaagcatttcaaatactccgtcgcggtccatttcgtaaccgctggctttctcagaaatgactttcacgacttccatgccgtttgcagcagcgatctcactgagctcctcttcctgtctttttaatgacgtttgctgctgttctttgtttgtgcttacgcgggcataaatgagcgccttcatttctctctttcctctctaattgacaatggccagctgatatacggccggatgcttcttcttaaccggtagaataagttcgtctccgggctttatctcagcagtctggagatgattattctccgtcacccactcaatgaaatcttctttattaatgtgtttcttttctgctacatgatccgcaagtgaccagagtgtatcgccgtcctgaacctttattttaacatattggctgagggactgatcatttcccgcacatgagacaagtaaaatagcggcacttaaaatcgcagtaaacagcccgacaaatatgatagattctttcgccatgtaaacaacctccgataagaatgtttgttcgctttttatatcttccagtatatacgaacaaatgtttctgtcaatcgtttttttcgaacctatgtttgtactgtcaggaaaatcatgctataatctacttaaaatcgacgttttgaggtgcgaaatatgacgaagctatcaaaaaggcagcttgatatcctgcgttttattaaagaagaggtaaaaacgaaaggatatccgccttctgtaagagagataggagaagcagtaggactggcttccagttcaaccgtgcacggccatttggcgcggctggagacaaaaggcctgatcagacgggaccctacgaaaccgagggcgattgaggtattggatgaagaagaagtccatattccgaaaagccaggtcgtaaacgttccggtcatcgggaaagtgacggcgggtattccgattacggctgttgaaaatatcgacgagtattttccgcttcctgaccggatggttcctccgggcgaacatgtctttatgttagaaatcatgggagagagtatgattgacgccggcatttttgacaaagattacgtcattgtcaaacagcagaacacggccaataacggagaaatcgtcgtagctatgaccgaagatgatgaagcgacggtgaagcgcttctataaagaagacaattatgtgcggctgcagccggaaaatccgacgatggagccgattatcctgcaaaacgtaagcattttggggaaagtgatcggcgtattcagagccgtccattaattctattaaacttcatttatcgtaaaaaacccctctgtaaggggtttttttgcataaaaaaagcagattcgccctggcttaagaaacgaacctgctaaggaggaaaaacttacattcttattatccgacatctcacttttgaagtcaactaataatgtttccctcaagaaacttttcatccatttttcaactttttatatatttgtgcgtgatgaatttgcttttttatcttttctttgggcgggcacgtcaaaaatttatatatgaatatttagtacatagtgtaataagttaaatatagatataaaaaaacccgctgcctttagcgagtatctattttcaatcaaaatgataatattctacaccgtagaaccctttaatatagacgggaccacagacgtttgaagaactttcaaccagaatcctgtatttgtgatacggatcaattgattttttatcctgggcactgaggtttaaccagctgccgctgtagtttttagaacttaatgtataaaaatttccgttcagcgccatccgctggagtttcatgcttaaaccgcacgaagagttgttcattatggtgaacttatatcctaaaaagtaatcgtcggcagctacagcacccggattttcaatatgaaactcttttgcgtttccctccaaagtgaagcttgtttttgatccgaattcagtggtagccgctttagctgagtgtattccgctaaaacataataaaaaaacagcaatacatatccagtattttttcatttgcacccccctttttacatattttaacttgtgaatcctgtgatgtctattcacattttactttataaccactatataccagtttaaaaatttgcggattgcttacaatgaagactaaacgaaataacgaaggtggttcaaatgaaacacgtaattgctttcgcttctaaaacggcgctcacacttgctttactgtacattgttctggatcttatgtaccaagtaacctttttaaacgttctgtttattacagtgatcttaagtttaatcacttattttgcgggtgattgcatgattctgccgagaacaagcaatttcacagccgttgcagctgatttcggaatttcattcattatattatggatattcctgatgaacattggcaggtttaatgtctctcctgccgcggcagcggttatctctgcactttgcatttctgtttttgaggcattttttcaccggtatttgcagcaatttgtacttcccgaagattataaggacacaacagagacggatagcacgctatggagctatcaaaccgaggcgtctgaagaattagtgccggaaaaagaccctcaggaaaaaacataaaaaggaggcaatcgcctccttctctttttacttttgcttctgatcgtcaagcggcagctgcagcagtgagtctgtgcctgtcgctttcggcgtttttccgtcccatttttcaatccatttatatttgatcatttcatcggacattgatttcttaatgatttcgttatagtcagcgatcccttccgcttcaatttttttctttttcgcttcggcttcggctattttaatttcagtttgtgtccgttctagttcctgtgaagacttcacccttgcatcgatggcttcctgtgtggctttatccggcttcggtacgccaagcgtcagatcatcaattaaaaatccaagactcttcatatcatcagcaaatctcttttgaacatcggccgcggcttcagcagatttttgcccgtatgtgtcaataaccgagtatttgctgattgattttcgcgccgcatcccacagccttgtttttaaatatgtattttcaatcgtttcaacgtctaccgccccgaatttgttaaacagatcgactactttatcaggctgcacgacatagttgtaagcgatatccatttctatatttttaccgtcagaggttgccacttttatattttcattattcactgtctgcatacgcaccggatattccgttactttattaaataatccgactaagtgccagccttggtccaatgtgtcggattttaccccgccattcggtgagtatacaaccccgacataaccgttcggtattttttcaatgaatagtgacgctgtgacgcccgcaattaaaagggctgcacctataatcacaccgccgagaattttttttgtgtttccgcgcttattttcgctcatgctgatcttcttcctcccatgacttttttaattttttggctccgcttcccacttgtttaaagattggactaagcaccagccataaaccgaatccgatgatgacaagaagaatgatagacccgatcatcactttcatttgcccacctcttttctttcatcctgtcaattatgtatacgatcttaagaacttaaagtttcataaatttcaaaagaaaaagccccgccgacaaaataagcgtgcttattaataattgccactgataaaatcagaaatcgtttttgtaaattggtaaaaggtcccgttttgtgcggatgctctgcttttcagcgtaaaggtgtcaaatagtgattttctgaagccggtgctcatttcgatttgaatactcaatccggatgaagattgattggcaaggttgttcggactgacgcctgcgtatttatcatttgtgccaagaagaacggcaggatacccgtgccgtttcagcacatcggtcaagagttcggcccgttctctgtctgtaccgccgatttttatctttttatcatcactgccgtaaccgtgcaatgaaatgacattagagtgccctttcaccatttgcacggccttggtttcatcgaaatgcgaacttgtcaaatgcagagctgcattaccggctgattttaacccttcaaataaatataaactccggttttcggcaatttctctggctaactcactggtccccggctctatgcctccgccgtgtatagctaatatgaggacagaagggtcatgctcccgcgttgaaatggaaaaatcggaaggatcttcattcagctttaattcctcgaaactgccgtaaagatctgaagcggcatcagcccgaaagaacggcagaagcaaaaacggtaaaattaaaattgaaattccttttttggttattgatggcatttgtatgtttatgttacaatacaaatgcttcagcctttgaagcgaacggcagaacagggtgactttggacggtttcttctgctctgcctctttgccggctgctttacggtctactcttctaacccttttttccataacatcatcctttcttttgtttacacttttgtcacaatattatatacgttggacaaaacctccgttcatcttgaagaataaaaacatcaaaacaacctctatcctttaacctaaaaaagtctttctgttcaaagagacggaaagcttaaatgataaaaatgaaacccttctccttagttttgtttgatttcccaattcaagaatccccgaaaaaatttgaatgtaactgctgtatccataaaaaaagactgctgttaagcagtctttttttcgttttatttcgtgcctgttgatcccagtccgccgcggtcattgttcccgagcttgtctacttcgatcagctccacttcaggcattttcttcatgattctgaattggcagatccgctcccccttggaaatgtcggtatcccgaagcgcgaatgcaggaaaaaaccagaagtcattgtcgcctttataagattcatcaatgactcccattgaatttgtctgaatgatcccgaaatgcttatatgtacttgaacgcggaacgacatgggcctcgtatccttccggcagttccatcgcaactccaagcgggataagtttgaattcatcttttttgattgttatatgttcagctgcccgcaggtcaatccaatcgccctgttcaattttactgattctcgtttgcgtatcatctgaatatttaattttgatttgtaaagtcatgttcgctgctccttttgcttccctatttcagtcgtattgatgaccaatccgtgccccattataccatttaactgataagaatgctgattttggtgtatatgcagccgaagaggaagcacggcgaagacaatgagaataaacctaaaatgaggacccctcctatcagtttttccctccattttcacatgacagcttcaattacaataatgcaaagctatatgtccgttcctttcaacagagcttttttaaaatttcgcctcggtttcaaaaggaatttcgttctgaataaagaatttgaagaataagcgcttaaagggcgcgcgattcttttctgtcccctgcctcaggcgcttatatcaaaagaaagaggtgtctttagaatggttcaatttaaaaactttcctgatccgtctttaaacgccccattgcagtctcgccctgcacagccctctgaattggagcatctcaaagcaaggatgcagaattttattaagcattccgcaacggatgataatcttgagatcgcagatgcccgggtgacggcggaaggaatggtcacctcacttttaaaagaacggcttgatacagaatacgaaatgcttatgaataaaatcacccgggaagtgaatgtggaggattacggagcggtccctgacggccgggacaatacagaagcctttcggaaagcgatcgggaacggccgggtcaaagtaaatgttcccgcaggagaatttttggttcaagggataaaactcccctcatggactactatttccggtgagggacaagggattaccgtgcttaagcttcatgaggacactcccgcatacgaatgggtcattactaacgatgattacgaaaatggaaaccgtaatatttttgtccagaacatgactttagactggaatcctgaccgtcaatgcggagtcaggaaccccggaggacagtgttccagctgtttaacgtttgctaatgtgcaatacggctggattaagaatgttgaaacggttaacgcgggtctgcatggtatagatattacatctccgacttacgatcatttgcctgaaacagaatggacgaaagacggctgccgttatatatggattgataactgtgtggcatacggcgccggagacgacggcattaccacccattacagcgaatatattttcatttccaactgccattccggaaacccccgcggcacagagcatgctgagggcagcgcaaactcgaacggcattgaaattgacgacggctctaaacatgtgtggcttttaaataactatacgagcggaaatatccgcgggattgaggtaaaggcgcacagcctgtggccggcttctcaaaatgttcatattatcggtcatgtttcgtatcgtgatgtacgttcatttgatattcgtcatatcggccatcatcaggcctcagaccccgaaagcacgacggcttatgatgttactttaaccgattgcaccgcgattgaaccggtattcaatgccctctatgacggtgtgaccccgagggcgctggtcatctctgcctataaaaacgtcaatgtaaacggattcacagctattggtgatccatcatacgactatggcgggaacccagtcgtggctcttcaataccgcagtcaaaatattacgatcaacggcattaaaatacgcggctttacacaagccggggttgacatcaatatatccggcggatctaataaaaccgatcatgttaaaattttaaattttgatatatacaagtcttctcctaaaggcatctcaatcggcggaggccaatataacgtaaatattatgaacggtacgatgatcggagacggcggttccgtcggaattacgtcccctaacagtcaggctgtcattctcggggtgcaagctgaaggttacagcgcggccgcatctataaaaggacagacttatgagcagatccccgtcaatttaaagggaggcgcacagctcgcgaccagctccggttttgcattcaacccgacaagcgccgttattgcgggaacaggcgatattacggccagaggtgacagaaatgcgatcatcagctcttccggaggttcaagttccgaaggttcaagggcatttatcgccgcttcaaacaatgtccatattacgggcggcaaagtctccagaacgattctgtcatcagaaagcattacattggaagaaccatacacggttgccggagggcatcagtccatcaaatggaaactggattcagcgggcggccacggtacgttcgccggagctgtcacctcttccctgtcagggtacggagaatattttgaaagtgtaaccggccagacgattcccgccgggacgatcgtcacagtgaaaggcgaaaaaattgaaccggctcacgtcggagattacatgctcggcgtcatttcagaaacagccgcttttatctcaggagccgcaagcttcggatggcaaagccgctttttgacaaatgagttcggcggtttcatatacgaaaatgtgactgacgaagaaacaggagaaacggtacgcgtaccgaaacaaaacccggactgcagtccggctcttgaagctgactatgaagcacgcgcggccagagacgaatggcatattgtcggactcaacggccggcattacgtacgggtcgacagtacggtcagcccgggagattatatcacggctcataacggaatcgggactaaagccgcggaaggctggaaggtattgaaactgacggccttatacagcgctgaaaaagggtacggcattgcaattgcggttatcaaataggatctcaatatcaggatcatcttctctcttttctatcgggcgggtatgattctgttttttataccgaatgagatgcctctttttcagcataccgtttcatttgtccaagccatccatgctttctgtcatagaatactaccgtcagatgaaaaaaggaggaatatgagtatgagtatggatatgggtatggatatgaacggacattatgatcaccagccaaagcagcctaaacaaaagaagaaaaagaagaaacaagataaaaagcatcttgattatgattacatcgttgtttataaaagaaaatgcaaaaaatgctgctgacttgacatatcaacactttttacacccggtaaatcccgggtgtttttcttattatgacgtttctccgggctattttcacccaaaatccggtcatcctatcacaatacataaaaagactctattattttcttcccttttcgcctgattaaaagtatttcatttacagaaaacaacataaatagaatgacatgacttttgagaaaatctgctctttgcttggtcaatttttctgcgataccatgaatttgcaacaatttttaaaaatttcctcaggaggtcatagacatgaaaatcgccagaacaatagtcggatcatgcttagctttatctctaacaattcctttcacagccagtgcctcagcagccagtcagtctgaacacccgaatgcgcctcacgtttcacccgttgcaaatccgttagaaagtaaattatcccaaacagcaggccaaaacgtaaaagcagcaggtgttgatgccgggctgaacgtaaacgtagatgttctcggaatttcagatcgcattgctgaagcggttaagtcagatcaaaaccgaaccggctgggtaaaaaatgtcatggaaacaacattttacgcatcaggacagaagtacaacgtcatggtgttcaatttaaatcaagaatatgaagaccgctttaacggcgttcaattttacggatcagccgtttatgacggcattacttacggaatctgggtcttcgaagacggttcctttgataacaaaggagacgggggctggatcaattgggcattcagaggatggttcgatcgtgataatcagcatattgaattccacagaccttaattcagagaaaacttgcggcagcgcccgcaagtttttattttgataacgagatactgtacatttttcaccgttataacgactatacttgaagtgcgggctccgatcgcagccccggtaaagtctttcaaagtgagggtatgccatgtcaaagtctttaaaaatagtgttgtggagcatattggttttcattatcttgttagtgatgatcggaatcgtttcttacaatcaaactccgtctgcagaaagcgcagcaaaaagaatgctttacagcgtctaatcaattttaagccttcatcggctttttttatttaccgcagaacacttgaagttcttctgtttagatcgttacgttcccattcggaatggagtatacgcgtatatcaccaggcagtccgttttgatacatggttccgattatgcctttcgcatcttttttctctattcctcatcacatccacttttttcatgctgctgctcttgaaaccaaccaatcatttcttcagcctgttccgttgaatcaaaaggttccaatcctaatagcgtgttacattttcatttttaaaaaaacaagccaactgcgcaccctcttcgcaacttctcaatgtatgagcctatccgtttctattacaggaagcagtacgattcctccttttactcattttaacggatggccatgtaaaggaaatatagactaaaaaaccttttttcaaaaagtaaactagcatccctatcaaacttttcatttcggcatagtatgtattaatcctctttaggaggtgagattatatgggattctcaggtggttatggtagctcctttgcgttaatcgtggtgctattcattttattaatcatcgttggggcttctttcctcggcggttattaagaatcctcttacctccgcatccatgtcagcagcacctccatgatcgtacggcgccataaatgaaatgtttatggcgctctgctgtttttccccttttcattcacacattaaaactaaaaagatcggccgatgaacatgcagccgatcagtaattcatagattattgtgtaaggtttacatcgatgacgttatagaaggcattggaagtatccgcaacgtcccatacccccaaaatgacatgatacccgcttcgattagtcggcacaaaaatcttatgagtcagattcgtatctgccttggaaccgtcgtggtttaccgttccgattaattcgaattcatctcttgacaaaggtttattcggattccagtttttcttggtgatataatagtgccactttgatgtcgcatgaggagccgtgtagtaccaagtaaaggtgttaaaaccgccgcggatgttttgttttacccaataatctgcagtctgcttgtctaaaccgaagtcaatttgtcccgatcccccatttgcagacgcaattcttccatccggcggacctgcagccggaaatcctttcggcccttctacagactgaggattatcaatgacggagccatatttctgcgcagcggccgtccagcccaatgtttgtttctctaaagctcccatgtacgctctgctgacgggctcttttatatacccgtgcgcagatgcatcacttgaatagaaagcgcctccaatcccaagagtaacagttaaaactgcagctttgaccaaacccttcattactgcatcatcctcccttttttgttaataaaatccctttcggtatatacacttcacgatagaggatgaaatgaccttccttttcttgataggaaaaagcaatgaggttcgcgctttcccctttgttttttataatcataaagaaaaagccgggccgattctgttttcgaatccgcgattgccaaaaaccggcccgccccttatgctcagaacttcattcgctggatttgcgggtttcttttcggataaccggtgctacttccgctgctaatcgttcgatgttttccgcggcttttttaaacggcatacctcctatatcgatttgcgcgagaaatcgctgatgcccgaacaactcatattgatgcatgattttttcaatgatctgctgtgaacttcccacaaataaagctgtttcttttccggacgcccgctcaaaatcttccttcgttaaaggctcatcgatcccgtgatatgaatgaacgtgagaccagtaatttgaatgatacgggtaaaattcttgtattgcctgttcattcgtttttgaaatgaacatatgtccggtcacggcaaccttcacattttccggaggatgaccggctttagaagccgtttcccggtatttgtcaacaagcggcttagatgacatcggatcaccgctcagtacagccaatgccaaacccgcacctgcacgcccggctcgttctgcgctttccggagtccccgaaacacctaaccatagcggaatgcttccgcaaaaaggccgaggagaaatttctgcctcgcgcagcggcggccggtaacgtcctttccaggtaaccgattcttccccggaatttaattttaaaaaaaggtcaatgtgttcttcaaacagttctttataatggcctacgtcataaccgaaaagaggaaacgagtctaaaaatgcgccccgtcccgcaatgatttccgcccggccgtctgaaatcagatcaagcgttgcaaaatcctcaaataaacggacgggatctgcggtggataatacagtcgtggcactggtcagcttaatattttcagtaatctgtgaaatcgctgataagatggccggcggcgaagataccgcataatcaagacgatgatgctcgcctaccccgaatacatcaagccctgcgtcgtcagccagtttcgccagcttcatcaattcatctatccgctgctttgcgctgactgttttccctgtcagaggatcgggatataattctgcaaatgaataaattccaatttccatacaatcacggtgttcagccctcacatttctctcctcctgcactgtgtaaaaaagcttttatgttattctattcagccgttttataaataggaatttattcaaaataaatacagaagcttaacatgcagaaggccggtatgagaggaaaaaaagtttccggcgcccttcaattctgcccattatactcatgcagccggactaggcaagaacaaagccggcacaagcggcttcgaattcatgtgttcgttttttcagtccaattcaatccaatcgtgatattgatcataaagctttcctattcttccggcatcaagagcgatgacttcacaccctctgtcatcatatagaaagaaaataatatcttttgtcatattcacaaagaaaacatcgggatacccaacggaacagcccccgaaccttggcttcagcggaaaatcttcgtggacggctgccttaagtaattggggaatacgcagatctttccgtttacataataaagaaaactgctgcatttcatattcttctgcatcatcttcttcaaacggacaggggcaggtcttcacctggatccgatataaatcatccttacacttcagaaacggctgataaacctttaattttctcgggtgattaccttgagttttgtgcttatatacgttggcaacaaggaacatgtcatcgctatgttcaaacagttcattgaaaagtgcggcggtttgatgatgaacaagctgaaaatactcaagattcaaagcaccgctttcattaaattgatacatattgccgccgagagaaaaatgaagtcccacgtcccattgatgataaatgccgggcactaattttaaagtcggaaacctttccttcagataatcatttattttcattcaaacatctcactttccgtttcccgctccagagacagaagaagccgaaaacattccgcttatttctttttcacccttgtaatattattccgattggaatacaatgaaatagaacactgtgaaccccattgatcagggtggatgctggtcacattcatcctgatcctttcttttacacaagatcgcaccaactttgatcccctccgtttccaaccttatacatatatttcaatggtattattttcttatacataagcatcaagaggtgtcagctttgaacaacatcagaagattaagagcatattttcagtctcaccgtaaaataggtctggctgcagacttgcttacggctgtattgcttatctcattacccattcttttttacggatgccggcagggagctgttaatggtttctttatgataagtaatttcatcggctccaatgcctcttttatcgacttcagcacatcgaggaaaaacagacaaaaataaaggctctgcgtcaaaaagagggttataccgccctctttttattctttcagtcataccaatgcgttcttttcagattgaatttttctgaataggactcatgatcggttttccatgctgcttcaacagtgatttcatgaccgatcacttcatgttccggcatatattcaaacgtttgaatatggtcttctcccgttccgcctccttctaatttctctccggtgtattctgaaagatgatagtctttatcttcaccatatttccggccgtcaacaaataatgttaatctcttaatcaccgtgttcttttcattcactttattacctctgtaatacaaattcaagaaatagttagggccgatagatgtcttgcctgatttttcgattgacgcttcccacgtcttgctttggctatagccgatatatttaactttttctcctgaaattaaagaaaacagtgcaaatccggctgctattatgagaacagtgataataaccagcaatgttttaatgactttacgttttttcatgacatcccgcctttatcatttagaacgtatgaatattagaattgttacatttaatttgaaagaataataaaaagggttctaattccaggaataaaaaaaatactaagaagatcatattccccttagcttcacatcccagactgccatgcaataatgataaaagtcgtccaaaaagttgtgactaaaataagcataacggttacaatcattaaaatgagacaacttattgttagaattgagtctttgtttttgttaagaatcagagtaattattgatcctgcagcaaatagatacgacaaaaccgcaccgacccaataccacagcatagagtcattgctccagtaagccattgactgcatataaatactgaatataaatcctgacaatgctaatagaaacgaaactaaatttgatttcacgttagagttcctttcttcataagttttatttttaggaacggtcatacatctgataacaccttttatgcgatatgcttcgccgctttgtctgcatattttaattcttatttcgtttttaagtatgtttacgaaaaaagaaatcatataaagttcacctgaaacgccgatttaaaattaaatagatgttttataagcgttaattgcttgatttctatctttcttaaccattccaagattgtatgcttgtttgatgatatccagcacttgattatcggtttcagttacagctcgtccaccagttattctggatttccaataatcaaactggtgatttcattctgaacagcttttaacattttgattatcaaccacttttccattctcaagcgcatcattgctgattcgattacttcccgctccttctgtcgctaaactgcaaaatgtccatcccattcatcctctctccaattttacaacgttgctataatgaattttatgtttttcccaaccttcaagcttaatctttttgatcgttactaatctaagttttttttcaattccataatccattggtatgatcggtaacctaatgaacttaaatacaaaaaaacctgcttttagcaaggttttttcgacaaaggggagattatttccccacaaattctattacctatgtttttgttttaaccattctttctttagcaatgcgtattggtaagtgttttcatatttaggtgttccatcctcgtgggcagtaaatgaaataaattcaagaaaataaccttctttacgcattcctaatctctcacatagtttttgtgacctgcagttatcatcttcaacatatgcataaagccttcttgcttctttttgcataaagagatactcaaagaaagccttcgcactttcacttgcgtatcccgccccttcaaaacgggcattgaaattccaacaaacggaataggtatctggctcttcttttaaataaaatagttctccgactagatcattactgtcttttaaacaaactgcaatataagagtcatctcggcttcttttttgaacatttacggcagcttcttctaacgtagatattctgtcatcaagaaaacaattcactctcggatgtgccgaatattccaacagaccttgtgcatctctttcggtaaaatttcttaaaattaagcgatgggtttcaattttttgcatttgcagtctcctgtttcattgttatcgacctttgaaaagaacttcttcgtttgttgaagaacttatcacaatctatttttactataatgaagagtgttatcatctttgtcaaaaacaataatcattcatttgccgcccgcaatgtaaagtactaaacaattttcgtgaaaaaccctcagtatcgaatataaaaacgagcaatagtaataaaacaaagttaagccattaaaagcttattgagtattttttcaaacttatttacgctcatcatctcatgagtgagaaatgtcccattataaaacacgctgaaagtcgtccaaactgccggggatttttgcgccatatcttttgacgatattcgccgggcctgaaaatgaagtcctttcttttcagtcagttcctttaaatcctttaacactccgactgcaaatgggcattgaactgtataaaatattgtgattccctcatcattaacggaattacttttcacctgttttttaaatagaggagaatgtgcgtgttcattccacgtcaatgacatcaactgaaaatagggttctgcttcatcttgcacagcaaatcccatatgctcgaagaaatgcttatcacttaaataagggagtttttcttccccactatatgcactatcccatccataccgcgggattttgcatctgacacacatttttctaacaagtgttttgcatgtccgttattcttatatttacctgagacccaaagacaattaataaacataaaattaggtgcgcttaccgggacccacgcttcttctgcaggtaaatattcaataaaaactttggcccgttcgtttaggcggtagaacaccaagccatcactcatccgatctttgagccagctcttcttttcatttaccgcatcctcatattgcttcgtacctaatgcacagcaaatatgattgtcatcaatattgtccctggtcaactcaatgtattccatttttcctcacccgctttcttttggaaacatcagctttacttccggtgaacattgtaatttctcagaaatatagagtcccagaaccaatatatgaacgcagcagcaatgctcattatgtaataaatgaaacttctgaaaactgcgaaatcaattggcggattatctatgtgccagaacaagaacacagctaaaaaagcgactgctgtataaatgaaaagatgaaccaaactaaagtttttaggcttctttcttagccatagttgcacaggaacagcaaacaaaaagtaagtaatgaatgcgtaaaaagcaatgataactacagtaaccaatgcaattggcacaaaacccgagtatacaaacatatatagcccgaaaatcaaaccatacgacaaacttgaaaaagccaacgtgtaaatatactttcgacttttgctccaagacgccgctcccataatttcacctgctttttataaaaatacattttccatttttttatttttaaaatcagtatatatccatcactttaaaagatctatgtttttttggcatatcatcaattcgctatcttaatatccagaaatttttttgccattaaaaaaggtcgctcaccaatctgcatccggctcatcgtgttcgaatccgtgaaatccacacatctccgcagccggctccttttgtgatcaataagtaatgatttatgtttgcatcaccattcaccttatcagccgagctcaagttcaaatgattacccgtgaaattcttttcactaagggtaaaatcatatcctgccggtgtaattctctgcagtgcaagtcaaatatctatagaaagattatgagcacaaattcaaagcattcagtgcatttggagatgacaaccccccatttaaaacacccttcggatgacaaatcatccatagaatcctccctgcatagctccctcaatttttgtagagacacttgtccgcaaaaatgtaagggttttcaaaagaagagtcgtgtgctaaattgtaagataagtaaaaattttctgcgaatatttgaaaggggtgtatgatttgaaagcagtagtagcaacgaaagacaaaagtatagagatcgtacaaaaagaattacgtcctttgcggcatggtgaagccaaagttaagatggaatactgcggtgtatgtcatactgacttgcatgttaaaaatgctgatttcggggatgttacaggcatcactttaggtcatgagggaataggcattgtaactgagattggtgaaggcgtaacaagtttgaaaaagggagaccgcgtctctattgcctggatgtttgaaagctgcggccgctgcgaatattgcttaactggccgtgaaaccttgtgccgggatgtaaaaaatgccggctatacagttgacggcgcaatggctgaagaagcaatcgtagcagttgattatgcaataaaggtgccggaaaacttagaccctgcagcagcaagcagcattacttgtgcaggtgtaacaacttataaagccgttaaagtcagtgaaattaagccaggtcaatggatcggtgtatttggagtcggcggtttaggcaacttggctgttcaatatgcaaaaaatgtctttaacgctaaagtaattgctttcgacattagcgatgaaaaattgaattttgctaagagcttaggcgctgatgcggttgtaaacagtttaaacgaagaccccgtcgctaaagcaaaagaagtgactaacgatttagggcttgatgcagtggtcatcacggctgtctctaaaacccctttcaatcaagcgattgatgttgtaaaagcaggagctcgcgtagtcgccgtcggtttaccggtggacaaaatggatttagatattccccgtctcgtgttagatggaattcaggtagtaggttcattagtgggtaccagagaagacctgaaggaagcttttcaatttgctgcagacggtaaagttgtacctaaagttacaaaacgcccgattgaagatgtgaatgatatttttgaagaaatggagcaaggcaaagtgaccggccgcatggttatcgattttacttcctaatcattaaggctgccgggaatgatacggcagcctttgatctctattcttgctctgcgccccacccagactgaatgagactttgtcatttagttcagaaaagaagctctacagaccattcagcggttattcattttgcaagtactctttgaactaaccctgataccaatataatgcaaggtcattcattgccgaagcgtagccctgctgtcttaacatagttgttatgctgccccgatgataagttccgtgattggcaacatggaataaaatttctgagtaagcagtttctctgtaacctaaccaaggattatttaagttcattttttgttctaaatctgtttggctattcatccattcttcaaactgtgaagtcagttcttcataagacgccgcaaattcatctgcagaatataaatgagctctttccgcataagccacagaaccttccaatgcttcctgcatgtctattcctttaagcacttgcagccacataacatccaccgcgcagatgtgactgaacgtttgagcaattgtaggatatgaactgtgaacctcttcataaaggacattacttggtaattcctttattctttctaataacgctttattcgcccacacatgatactgatacatatttttcgcatggttcatttaacatctctcctttaaagttgatacttgtgattataaaaaaagatatatgacagcagattgtcatacatctttataaattttcattattttttcggcttcatccattaaaattgattgcagttccagcggttttataattttaacgccactgccaaagctcaaaagaattgatttaagccatccggcatgctgaggccgatacacagagattgtaaacgtcatacttccatctctgttcatgacttttgaagcgttctgaaattgatctaatactttagctatggaattaggattaacccaaatgactacatccgcaaaccctcctaggtcggattctgaataagatggttcatctttcactttgtgactgcgcaaaaactcttcttgagtaagcgttatattcatcatacgtgatactctaaattctctatcatcttgacgttctctgcagaagccatatacataccaattacgaaacttataatgaaggtggataggttctacttcacgtgatgtaaattcatttttattactgacataatcaaagcgtactgcctttttttcctgtatagcttttcgcagccggattaatgaattcggttctgttcgaaggctttccaagttaacatacaaagtcccgctgttttcgcttgtatccagagattttaatctatctatcgtgtgttcaacttctttatcttcaaaaacactcgacaaactgcttaatactgtaattaaattcaatacatcatgagaaccgattaaacttttatcaaatttgtatcctctcattatcccaaaaccgccgttagccccttggtatgaaacgactggtattccagctgcacaaatcgcttcgatgtctctataaattgtccgcgttgatacttgaaattcatcagctaaactggaagcagataaaatttcattatgtaagagcttgaaaatgattgataacaaacgttctaatttcaattctcaattcctttccttattagggttggaagtgctctttttactctgacacatttatgccgttcacctcctgtcacttcaagataccacgcagaaagcttaatttttccacccaaccgcataatacgcgaattaccatatactttgtgaccctgataaacccttctatcgcttcatctgatattcaataaaacgcctgttctcttcactgagtaatttgaggctcaatttaatctacataatagttcactgaatctctcaacaattttagataaaaatcttctttttatagagatgttcgttctatcgacatccttatgataaatatggtaaaattcttaaaaacaagggagtgttgttacatatgagtcttatcattttagcatccacgcttttatggggtgcagtgatccacgagctaaacaaaccttcaaaaaagcaaagtaaacgaaaaatgatccctttggtatccctcagttctttatctactttaatcatcacaatttcgcttttttctaatttaattagttgatatttgttatgaggaaacccgccagaggttcctcataacactaaacctactcactgcacactttacagcagaccttatcagagtgtttgcttaacactttgtccattctccccacaggcatcttcttctcacttggaagtgtaagataagctgttatctcatcccctgattttaatgtttttccgcagatagagcatgttaactcagtattaaagaaattttttaatcccattcagaagcctccttatttacctttataaagtaatacgttaatgctttataaaagtttcacgttaaagaaatactacttgcctgggaatatacttcgtttcagttgatccgcagccgcttcggtcaacgttgcctaaatgatatactcacttaattaggaggcttcttccttattctgaactggcagatacgctgatgttcccgcacagggttaacgatcgcctgctttaactccaagatacttccaataaggagaccgccgttcaatgcaatctctgcgtttcatattgattgtaaaacattagagtgaagtcatcttcatgcattgaccagtttactgcagtgcatggattgttaatttgtgacatttatttgtcctctttaaatttttcttcttctctcaacttgaaaaagaaggaattattttataaatattgtaaatttatagctgtatcacattcactattaagaggaggaatacgaatgaaaaagaaaattattgccggcgctcttgcttttgggttaattccgctaatgggggctgcagatgtttctgcaaaatctttgccaaatcaagataaagtcatgaaacctgccggttggtcatgtgacgctccgtatattgcgtgtcagcctttttctggcggtaccggtaagatttcattcaactatcaaggcagctctccaggaaaaatcagagtttttgtagcgaatgacggcagcaaatctttcaaattcaccattaattatcctaatgggaatacactcttatcctctacgacactaaatgcggggaaaacgttcattcaagaattcagcgttaaccaaaaaggagaatacatcctgaaatatgatagcggcaccggtgatagtgtcgatggtttctttagatctgttgagatctaaattccgttaggaaagtcggcagttttgccgactttcttttccaagcattctgcaggaataaacgtaaagtgtcgaataaacatatgacctttttgaaacggaaactttatctgcaccacaaacccgcaagcagcctccttgtatcgtaccttccgtccctttgtgatttgttttgatttgtcgtatactgcgcttgcccgggaaatgatgaatattttcgttaactataatttccctgtacctcttcgtatgtggctctgcatgatgaagtaacgtcatggctcaccactttcatccacagttttattgcatgttgagccatatccctcctctttaaacagcaaaccgtcccatccatttctctctttccattatttcatattcttagaagctcttcattttagacttaatatccattttttcttatttagacttaaatctatgtcgaaatttatcgtccggcatattatgtactatcctaacaacaggaggtggcaataatatggggaactacggtggaaattacggtggaagttctttcgtattgatcgttgtgctgttcattttgttaatcattgtaggtgctgcattccttttctagcacattgacgatttatattcgtctcccaaacattgcatcccttagttcggacagacgccataagaagttttatggcgtttttactttttaaaaaaatctatctaagataaacattttttattttcactctggtaagcgggagagttttctcccctgcctgcgccaatattgccgctatgaagaataaggtgaacaattcaattcggaataaagacttgttcatgaacaaaacccctaaatagttgttaaaaaactaaggcgtttttaattcatcaggattacagaggttgtgaacttaaaaaggatattactcacctttataaaattgtcatcgttagatttagtcactgaatcttttttgtaagggtccgcccacaaaatgcggtgttcacacattaaatcattttcacataaaaaaaccggattcctcttctaaaaggttccggcttttctttttgttcggtatttgtcagttaatatgcaggaaatatctggtgacgtgcacacacccgctattataatatttcaatagagccttctgttccatgaacgcggattcgctgcccatcttttatcaattgggttgcattttcaactccaacaactgcaggtaagccgtattcacgcgcgataaccgctccatgggtcatcagtccgccaacttcagtgaccaggccttttatggacacaaacaatggtgtccagctgggatcagtatagggggtaactaatatatccccatcttccaaatcggcatcttccatgtttaaaataacccgtgccctgccctctatgactcccgaggaaacgggcagcccggcaatcgctccggccgggagattttctcgtttgtactcgcctgtaacgatttcaccgtcagacgtgataacacgcggcggagatagtttttcatatactttgtactcgccttttcgtgtgctgatgatttggtaatccaatttatttgtgcgtacgacttcctgaagttcttcaaaagtgagatagtatatgtcttctttttcatgaataacccccgcttttgcgagttgttcggcttctttcagtaaagcctgcttataaacgaagtagcggctgatcatgccgtattttggatattctctgaatccgctgaagttccggatgatttggatcattcgtttagtttctctagctttttgttcaccatccggtaattgcttcaatcggtctaataactcttgttctttcttcaacgcctcctgccgcccctgctcaaatttccgctggctggcatttggctcaaagtttttgagattattaagaatcatagggacaagtgcaattggtttttcgctccatcgagttcttgtgatatcaatttctccggcacatcgcattccgtacttgttgagataagcatagatagcgtcatgggtttcccgcccgccttcaaacttcaccagcccatccaaaaagtgatcatcttttacattctctaaataggcaattacttctggataaggacggatcacatcggcgacgtccaatagcgcaagccccatttctgaagtaatattatggggtacagattgagaaagcgtatctgctgcgtttttttcacctaaccactcgttcattttttcgttaatccatgatgaagcatccattgcagttcgaatcagcaccgaactttttggattaaataaaatattctttaattcctggatatcttccaaaataaaacgaaataaatcagatcctgatttcgtctggatgttttgttttaactcttctatcgatgcctgactgctcttaatcaaatcagaaacaattgcaggatcgttttcagcttgatccggcatatccgcattgcctttgccgggaatcggcgccattttatcaggtatcggcttaatgaaatcatctcgctctattatggtcataagtgcgtcttttaagagcggatcgtgctgccccataccttttaagaaaacttctctgacattaggggatgccagttgatgtgtgacatcaacgaatagccttccgccggctttacgcataggtgcagcagtcgtcaacagaaaaaaagacaatccaaggggttttatgggatccgtcatcatttgctgatgaccgacagagatatagacgtgattttcttgatcgttcgcttcaggaacggggtataacgttgtgatcggacgactttggacaatataaaaagtatcgcggtccaaacaccattcgatatcttgcggctggccgaaatgagcttcgatctgtctcccgatacgtgccagctgtaaaatttgttcatcagtcagtgtttgaatcttttgctgatcaagatcaatctcccgtgtttccgttccgccttctcttcgttcatagacagccttttttttggtttctattctcttatcgacgattttcccgtcctgtactttataacaatcggcagatactaagccggagaccagtgcttcaccaagtccaaaaccggcatcgatggacagcagctttcggtttccggtcatcggatcagcggtaaataaaatccccgaagcctggggaaacaccatcctttggatgataacagataaataaacttggctgtgatcaaacccattttgcatacggtaaatgaccgcgcgatccgtaaatagggacgcccaacatttactgatatgctgcaagatcgcatcgacgccggtaatatttaaataggtgtcttgttgaccggcaaaagaggcatgcggtaaatcctcagctgtcgcactagaacgtacggcataggcatgttcttcgccgaaccgggagagatggcaagcgactgctttgactacatctgaaggaatttctgcttccataatggtttgccggatttttttgctgacttcaccaatttgatcccgattctccgctttcagcatggtcagttgatccaacagcgcttgtaacgtttcgttttgttcaatggcttttcgatatccggcggttgtgacacaaaatccttccggtacttgtattccttgaatttttgataattctcctaaatgtaacccctttcctccaacgagcaaaggctgtgttttttcaatttcgtgaatgccgagaaccaaagaactcattctatatctccccttcaaaaaaatttgacaagagcttttcagcatgatacaatcataatataaggtggataactatgacttttcacacagaaagcgcgcgtgttctgattatatcaccgtgtctgtttttgtgcaatataaaaagaacctggccaatttggcgaggttctttcttcattttctaaggaactcctgaagttgagtgatacctgtgaatccattgcagaaaggctatccccacggattcaagaaacaggaaaatctcaataataaaaaaaatcccccacgcaatgtgaggggatgtgttgtgtgtatacttctcatttcatcgtcatatgagtttagactgatgcagtcacaacttacaagaatgcttatctgtttccttcaatagtgttaacacatttgaagttattttagcgctgccgctgctttgatatccctaaactgtaatcgcttaatgttttgcgcgggagaaagaattgcattccatgatttattaatgccggctttctcatttgttaacagatttataaaaccaaggccattgataatgagtggtcgtttattgttcttcctttgacctcctgaaaattaggtttgtctaaagctctttaaagctgtattgagatcttttgtgtgaacgtaaatgtttttatacaactcgaatagtgttttatatttttgaacattttgttcttttggataaaatgcagctgcttcatgaatgaactgctctgcacattcttcaagagagtcaaaccacccgcttccgaaggcagctaacatcgcagctcccatggccggaccttgttcattttctaacttaaccaccctcgtattgaaaatatcagcctgcatttgaagccacgtttcatttttagctcccccgccaatagagacaaccgtatcaactgattttcccgcttcgcggaatagctcaattgattcatataaagagaatgtgatgccttccattatcgccctcaaaaagtgctctcttttatgggctccgtccattccgatcaagcttccccgaatagatgaatcagcatgcggcgttctttcaccgactaagtaaggagtgtacagcagtccatttgctcctatcggaacagattccaccccccgcaataattgttcaaacgattcgttcggcgcaaacgttcttttaaaccagtccaagctgtaccctgcagcgagcgtgacccccatcgtataaaaagaatccttttttccatgattaaaaaagtgcactttccctttaaaatctctttctttgtcttcttcacaggaaagtatgactcctgacgtcccgatactgcataatgtttttccggaagaaagaataccggctccgacagcaccgcaagcattatctgctcccccagcgtacacttttgttttttcgagcagccctgtcttcgccgcaacgctcggaagcagcgatcctacacaggcatgggattcaaccagcggaggacaaatttccgctgaaataccaaattgattgcaaatctcatcgctccactctttgcgggtcatatgtaaaagtaacgttcccgccgcatcggagtattcggtgtgaatggcgccagtcatgcggaatctcacatagtctttcggaagcagaaaaacagcggttttgttaaaaagttcaggctcatgttccttcacccataacattttaggtaatgtaaacccttcaaggacacgattttttgtgatatcaagcagatgatcgccaaatgtctcggttatcctgctgcattgaggcgtcgttctggtatcattccaaagaatcgcatgacgcagcacccgccgatcttggtcaagcagtactaatccatgcatttgtcctgaatagctaatcccgtcaatatccccggcttgaacgttggatatcgaaatcaattcagccaacgcttcaattgtttgctgcacccagtcttcaggattttgctcactatatcccgccttctcttggatgagcgggtaacttttggacgtttctgcacaaaccttgccgttttgattgactaaaatggttttaacggcactcgttccaaggtctattccaatgacatacttcattttttcactccttcctctctaaatagatttccgttgaaatgacccgccataacagtaacttcatgacgggcaattccgggaacttggctgcctgcatcttttatggcgggatctggagcttcttttttcatttggttatacctgtaaaatgtattggtttaatatcgcttttagccgttcctgtctccctgattcgtttttaattggctgattgttcagcgcatattgctcaagtgtcttaaaatcagctcttccttctgcaatttcaagaccaatcccttcagtaaagctgcggtaacggtgttgaatcacatcttcaaacacacgatcttcgattaatttgtgggcggctttcaaccctcttgcaaatgtatccatccctgcaacatgggcatatagtaaatcatcaggctcaaaagaagatctcctgacctttgcgtcaaagtttaatcccccgcttccaagaccgccattttgcaggatttcgtacattgctaatgtcgcagaatataaatctgtcggaaattcatctgtgtcccatcctaaaagcggatcaccctgattcgcgtcaacagagccgagaaggccatgcactctcgccatgcgtaattcatgttcgaatgtatgcccggctaatgtggcatgattggcttcgagatttaatttaaaatgattgtctaagccgtattgctttaaaaaggcaatggttgttgctgcgtccgtatcatattgatgggtggtcggctcttttggttttggttcaatcaaaaactgccctgtatacccgatttccttcgcataatccactgccatatgcataaatctggccatattatcaagctcaaattttaaatcggtatttaacaaagtttcgtacccttcacgtccgccccaaaatacatagttctcggcgccaagctcttttgctgtttctaatcctttttttacttgggctgcggcatacgcaaatacatctgcattacaagaagtcgccgcaccatggacgaaacggggattcgtaaacatgtttgcagtattccataataacttaacgccgctggttctcatgtagtcttttatcatgtccacgattatatccagattttgatttgtctcttttaacgtacttccttccggtgcgatatcccggtcatgaaaagcaaaaaatggcgcatccagtttttcaaacagctcaaacgctgcatctaccctcgctctcgccagatccatgcctttatagtgatcccacggtctctgcatcgtagctgcgccaaaaatgtctgtgccgtcagcggtaaatgtatgccaataggcaatagaaaatcgcagatgctctttcatcgtttttccgccaattacttcttgagaattatagtatttaaatgctaaaggattcgtggattctttcccttcgtaaatcactttgtttacgctttcaaaatagttgactgaaccggaatgagagtgagccatgtgtgatttcccccttaaaaataaattctaaacttgatgattcgaatacagatgattttatgtcatgttatatattagtttgttgcctaaacaaactaacttattttcatcttatataacctcatcagtattttcaatattttttttagttttttacgaacacattagatataataaaggttggattcgctatgtagcgtttcgcacgataaacacagaacgttcaacttaatttaaagattatacaaacggagtggatgaagtggatatcgctgatcaagcctttgtcaaaaaagttaaccaaaagttattactaaacgaaatacttaagaatgctcctatttcaagagcaaaattatctgaaatgaccggattaaataaatcgactgtttcatcacaggtaaacacattaatgaaagaaaatcttgtatttgaaatcggtcagggacaatcaagcggcggcagaagaccagtcatgcttgtttttaataaaaaagcaggatactccgtaggaatagatgtcggcgtggattatgttaatggcattttaacagatcttgaagggacgatcgtccttgaccaacaccatcatttggaatgcagttctccagaaatcactaaagatattttaattgagatgattcatcactttattgcaaatatgccgcaatctccgtacgggcttattggtataggcatatgcgttcccgggttaattgataaaaatcaaaaaattgttttcgctccgaactccaactggagagatattgacttaaaatctttcatccaaaagaagttcaatgtgcccgtttttattgaaaatgaagcaaatgccggcgcatatggagaaaaagtattcggcgctgcaaaaaatcacgataacatgatttatgcaagtatcggtacagggataggaatcggcgttattataaacaatgatttatacagaggggttggcggattctctggagaaatgggacatatgacaatagactttaatggtccgaaatgcagctgcggaaaccgaggctgctgggaattgtatgcttcagaaaaggctttattaacatctcttcagacgaaagagaaaaaagtgtccactcaagatatcatagacctcgcccatctgaatgatattgaaactttacatgcattacagaattttggattctatttagggataggcctgaccaatattttaaatacatttaatccgcaagccatcattttaagaaacagcatcatcgaatcgcatcctatggttttacattcaattaaaagcgaagtatcgtccagggtttattcccacctagacaatagctatgaattattaccatctatcctaggaaaaaacgcaccggcattgggaatgtcctctattgtgattgatcattttctcgacatggttcataactgaaatgtacaaacttctatgttttacgctcatctttaaagatgggttttttgttttgttattttcatcctgaatgggagcatttctgacgtgtttttccacacgggcattttctaatatgaaaaaggagttccaaaatagaaagctcctttttcatgcggacattcatttttctttataacggaaatatctgaagtcggccggaatatgatttccgctcgtatcttggcattgcatccctacaaaagctcctgtaaagaatcccccgccgcggatgtaatcatctgataatttttttgattccaatgcaatatcgattttgtaccaatcttctttgttaaatgaatagaaataataatatttttcgttttcaatattcacttttaaatagacgtacttgacttcacaagaaatcacaattttattttttaacggttgtgaaaaagaaaagttatcacatatcgttaattcaagaatacggccaagttcttcatcatgcgtgacttgaagagccgtccagttctctgtattgtaatagttcaccaaaccagcggcttgctgaaaattttccggataaaacgcaacagccgtttccgcttcaaaatggagactttgccagcgtctggctacaaatgcctgagtaaatgtcgaagttaaggattcatggccgtataatcgtaaatgatttggcgcttgagttaatgaacctaatttctccgtaaaagggattcttaacgtttgaaaattaatatttaatgtcgcatcctcaaattcatcaacttccggatacgtgtcttcaaatatggtttcaggtatagaaggcgcatccacctccaagctcccttcttttccgccttctacataaggccagccatctttccaatagagcttttgaatagctgtttctctgcccaaaggacaatatcctctctgctgaaaaattgaatcatcgtccggatgaatgggacgtcccgttaaatgggctaaataccactcacctgtatgtgtttgtacaatagatgcatgcccgcatttttgcaatgggtttcctggatcatgccatgacgttaagattggattatcgggatgaacttcatatggcccctcgatatttgcagaacgggcaattgtagcagcgtgttcgaaccgcgttcctccttctgcggttaataaataataatagttcccgatatgataaaggtgcggcgcttccgtcagctttctttcagttcctttaaatatcactttcggtttaccgatcagtttttgctccttatcagaatattcctgcatgacaatgcctccaaaggagtgccgatcaatacgctgatcccataacatatttaataaatatttttttccatccgtatcatggaacaaagaagcatcaaaccccgagctgtttaatgtgatcggctccccccaatcaccatcaatcgtgtcacaagtcactaaataattgtggcaatctttccaagcgccatctacgaccttaacatccgtatagatcagccaaaactttccgtcgctgtaacttaaacatggcgcccagaccccgcctgaattaggatttcctttcatgtctaattgcgaaactctctgtaatggatgtgcaactaagtgccaattgactaaatcttttgaatggtgtatctggactcccggaaaccactcaaatgtagatacagcgatataataatcctctcccactctgcaaatactcggatcggggttgaatcctttaagtactggattgataatcttcatgcagaacgcctcctcagctattttctgttgactatcatgttttaagctttgaaatcgtcaatatgatccaaataaactttgtctctattctctaattctcgaaccatgtttttatattttttctcatctaagttatagaaattaatatcaatcatggccagaaccagtaagaacacgggaataatggttgctgtaattaaaattcccgtcaatgcctccggcgtttgcgcctgatttgccacatatccaaactgatctagaaccaaacccggtacaacccctcccaaggccatgccgaatttaaagaaaaatccgataatagcgtatatgagaccgcccattcttttcccggtcttatactctccatattcgattgtttcaggaataagcgcccacatatatcccccggcagtgagacttcctgcagcggccagcaatcgaaaggaaagtatcaggaatacattacttggcggaacaaacagtaaagctaagaggccgatcatattcagtaataatgcatagtttagtaatttcttcttccctaataattgatgaagctttggaataaacggtaaaatgaccaaagcaggcaaacttcccaacaaaccgtaccacttcactaaatccgctctttctaaattatacgttacgtaatagatgccaaccgaattactgattgaattcactccaaaaataataataaaaaaaatacttagtacaactagaggccgattaacacgaaattgctcaaatatatccgataatttaattttttcttcagatttttgaagcgtgacacgctcttttgtgcttttaaaacaaaagattaaaaggcacccgcctataactcccataatacccatggttagctgccagccaagagattcgctgccggacgtatcgcttaaataagcagccagtaagggaacaaaaaatgcaacgacaagtcccccaagattcgcaaataacatacggacagacgttatactaacaacttcttgattatttcgggtcattgcagaggttaacgcgccatatggcacgtttatcattgtgtatgtaagcgataaaccgacataggtgatataggcatatattaatttcccaatatccgaaaaatccggggttgtaaaacagagtattgccagtatgacaaatggaaaagctccgaataaaagatacggtctgaagcgtccaaacctgctatttgttctgtctactatcgttccaataaaaggatcagcgagagcgtcgatgattctaaccactaaaaacatcgtaccggctgttgctgccggtaaaccaaatatatctgtatagaagaacaaaagataagtagacactgttgcataaattaaattacatgcaaaatctccagacgcatatccaactttttcaaccatgctgatcttctttacattttcactgagcatgatttcctccccttttcgatcctttacataaggaacatgatgaatggtataacatttcttcaattttatcggccagtgaggtctttataaaagcgctttcaaaaaatgatagcagtttactttcacagagcactttcatcgtagtgaacaggataaaagcttggctttcgttttatatatacctccaattaaatcgagcctcttatcccccttccatttaagacctttacatgaaggacaattaaagcggtttattagtttgttgatcgaacaaactaacttgatttcatattataaaatcttttctgctttttcaactcttttttcagaaaatttaaaaccgatcaaaggacataccatgttgtaattgccggctccttcgacagacgttaagtaaaaaccctatgtgtcacctgactgatttattaaatgataagcacttccatcatcttttgtttagaaaaacttattaagaaacatgcacttgaaaaaatgcgaatcatatataagtgatatcccgtttaattggttgaggaggatattatgaaacctatgctgccttttgaaaaatattttggtgatttagaactggtttatgcattttatggagctatgcctaccggtgttactgtctcagaaaccggtcgtatattcatttgttttccgaaatggggagacgatgttaaatttacggcagcggaaataattggagataaattgcagccttatcctgattcacaaaccaatttggttaactttgagaatatcaaaatgactttcatcagtgtccaaagtgtagttgctgatggaagaggaacgctttggatactagatacagcggcgcccaatttttctgaaccaattaaaggcggggcaaaattagtcgctgttgatttaaaaaccaatacaatcagaagagtgtatacctttacagaagatgttgtccttccaacaacctacctgaatgatgtccgatttgattttcgtgtcggaactgcaggttatgcctatataacggattcttcttccaaaggaccaggagctattatcgtcgttgatttagaaaccggaaacgcatttagacggttaaatggagcaaatccaacttcaccggattcctcttttataccgaaagtagaaggcaaaattttgatgaatcgtaacaaggatggttcaacttccccatttaggctggcatccgacggtattgcgatctctcccgacggaaaggtattatttttttgtcccctgaccagccgccatttgttctctatctcaacagaagccctgagagatagaaatatatcggacatggatttactttatcatgtggcgtattggggagaaaaaggcgcgtctgatggaatgattacagatgcaaaaggagccgtttatgccggagattacgagaacaatagtattcgaaagatgctgccgaatggcacaatggaaaccatcgcacatgatccgagaattttatggccggatactttttcgattggtccggatggatacttatacgtcatcgtgaaccaattacatcggcaggctagatttcattatggagaagacttacgacagaaaccttatagtttacttcgtatcaaaattgatgaatttcctgctcctgctttttgaaaataaaaatggccggttcaattttagagcataattggcttcatttagcctccatcctaaaccgaataagggattacaataaatacgtgtcctcaattatggagttagattcataacttcattttttttggtcaaggaccaaaatatcgacctcttaaccttttgaccaaaacttaaaaaatcccctgacaccaatagtgccaagggattgagagattaatactgagacatgtattgttcgcgctcccacggatgaacctgtgtgcggaacatatcccattcgatttcttttgcttcaatgaagtgttcgaacaggtgctcgccgagcgctgcaaccatgacttcgtttgatttgaattcgtcgagagcttccgccagtgtcgccggaagatctacgatgccgttttccatgcgctcttctttgctcatgacgtagatgttgcggtcaatcggagccggtgcttcaagtttgtttttgattccgtcaaggcctgctgcaagcaatacgcttaacgccaggtacgggtttgccgccgggtctacgctgcggacttcaacacgcgtgctgatgccgcgggaagccgggatacggatcagcgggcttctgttttgcgcgctccatgccacgtagcaaggtgcttcatagcccggaacaaggcgtttgtaagagttcactgtcgggtttgtgacagccgtaaagcttgtcgcgtgttttacgataccggcaatgaaatgttttgctgtttcactcagctgaagatcagcgtctttatcaaagaatgcgttaacgttatctttaaagagtgataggttgcagtgcataccggaaccgtttacgccgaacagcggttttggcatgaatgtcgcatgcagaccgtgtttgcgggcgatcgttttgacaaccagtttgaaagtttggatgtcgtcacaagaacggatggcaccggcatatttaaaatcgatttcgtgctgacccggagcaacttcatggtgagatgcttcgatttcaaagcccatttcttcaagctcaagcacgatatcgcggcggcagttttctcccaagtcagtcggagccagatcgaagtatccgcctttatcgttcaattcaagcgtcggttcgcctttttcatctaatttaaacaggaagaattcaggctcaggtccaagattgaaatcgctgaaaccgagttctttcatttctttcagaatccgtttgaggttgttacgcgggtcaccttcgaacggcgtgccgtccggattgtaaatgtcacagatgaagcgtgctactttacctttttcagccgtccatgggaagattacaaatgtgttcagatcaggatataagtacatatcagactcttcgatacggacgaaaccttcgatggaagaaccgtcgaacatgcatttattatcaagtgctttttcaagctggctcacaggaatttccacgtttttaatcgttccgagaatgtctgtgaattgaaggcggatatactttacgttttcctcgtttactaattttacgatgtcttctcttgtgtactttgccatttcgtaaaactcctcctctaaaaggtaaatgtatatagcaaaacagttgctaacggattaatgaaagaatcgggacatgtcaccttggcggaaagtatttccccgctggaaacggcctgcctgcatcagttcgtttttcagaagctttctgagttcgtcatcagacagattgtgcttcatcggtttggcggttttttcggatttttcttccggttcggcagatgccttatccagaatttgtttgatccccgccatattgacgccttgttcaatcagatttttgatttctaacagtttatctacatcatggaatgaaaataatcgtctatttccttcgcttctcgctggaaatatcaatccattttcctcataatatcgaatttgccgggcagaaagttctgttaactgcatgacaatcccaattggaaataaaggcattgagcggcgaatgttatcactcatctcaatttcctccttttcttatcttagtctcattataggtgatgttatattttgtgtcaacacaatgtaaggaatcttaacatcaaattctttgaaaattgcaaacgccctaaatcagctctttttccattaaagcatttacggcgctgcaaatcgcatttttcacgtgcgcgtaggttagtcctccttggacatacgcgacataaggcggtctgataggtccatctgctgataattcaatgcttgctccctgtacgaaagtgcccgctgccataatgacatcgtcttcatatcccggcatatagctcggataaggcttcacatgcgcattaatcggtgatgcatattgtatcgcctggcaaaaagcgatcatcttatcagggtcctgaaactcaactgattgaatcagatccgttctcggcgcattccatgcagggtttgacgtaaagccgagcttttcaagaaaacgggcggtaaataccgctcccttcaagctttgcgccactacatgcggagcgagaaagaaaccttgatacatttcctgcagtgaataaagcgaagcaccggcctcacttccgattcccggggaggtcatccggtaagagcaggcctcaatccacttggctttccctacaagatagccgcccgttttagcaaggccgccgcccgggtttttaatcagggagccggccataagatccgctccgacgtggcagggttcccgctcttctgcaaattctccgtagcaattgtccacaaaaacaatgacatcctctttgatttcctttacgaaacgaatcatctcttcaatttcatttattctgaaagacggacgattcgcatatccttttgaacgctggatgccgatcacttttgtattcggccggattgcagcccggactgcttcaaagtccactctgccttctgatgttaaatcgactgcattgtatccgatttgaaattccttaagcgagcctgaatactccccgcctcttactccgacgatttcctcgagtgtatcgtaaggcttgcctgtgatataaagcaattcgtccccgggtctcagcacgccgaagagcgcgattgaaatcgcatgcgtaccggaaatgatttgcggccgcacaagtccctcctctcctccgaacacatcagcatagatcttctccagtgtatcccgtccgatatcatcataaccgtatccggttgaaggcgtaaaatgcgtatcgcttactttatgttttctgtagctttgcaggactctccattcattccgttcactgatttcttctattcttttatgaacggcggagatttccgcttctgtttcttcggcggttttttgtaaaagagcgccgtgggtcagtgtgtcaaacatgttgtgtataccttccttacatgaatttcttcaattctccgagtatgctttgttcttcctgtacataacctgagacttcgtagcgttcattttcttcattaaaataaaggctgtcgatcatggtctctgatttgatgcgtgacatcaatttgccttcggcggcaggcacatgaacttcatacggcatcatcagctctcggcgcaaataagcttcgatttccgcttttagttttgcttcatccccggcgattctggcgctgatcatgatgtggccttctcccgctgtcgggatgaagtcaggaagtgtctcgtcacgtttgttataagcggtcagcaccggaatatcatctgcctcaagctcttttaacagaccgaggacagtctgttcatgcccggcataatcttcattggatgaatcaatgacatgaatgatcaagtctgcttccttcacttcctcaagcgttgaacggaaagcggcaatcagcgtcgtcggcagatcctgaatgaaaccgaccgtatcagacaaaaggacgctgtagccgcttgggagcgccatctttctcgtcatcggatcaagtgttgcaaacagcagatcttcttcatagctgtctgagcttgttaattgattgaaccacgttgattttcctgcattggtataaccgacgagtgcagcctgaagcacgccgttctttttacgtctctcccgataacggcttctgtggcggataaccgttgacagctgcacgttaatttcgtgtatgcggtttctaatgtggcgccggtctgtttcaagctttgtctcaccgggccctctcgtcccgattccgccgccttgtcttgagagattgattccttgtccgctcagacgcggcagcgcgtattgaagctgggccaattcgatctgaagctttccttctctcgtcttcgccctttttgcgaatatatccaaaataagctgcgtgcggtcgatgatcttcgcttcaattgcagtggcgagtgatttaagctggctcggtgacagttcatcattaaaaataaccagatccgcttcaagctcttcacacagcgccttcagctcgtctactttccccttgcctatgtatgtagcggcatccgctctgttccgtttttgcgtaatccgggtcagcaccgttccgtcagccgtttttgtcaatgaagcaagctcttccatggaatgttcaaagtgctcatctgtcatgtgcggaagctggcagccgaccaaaatgaccgtttctttttttccttcctgttcgttcaaatggatgttcctttctgtgtcgtattgggcagtagtactatcataccaaacccgcagggcgtataccacacatccggcgggttttaaagagagaaataaaaaagagacccctcaaaccggctgagaggtctattcgtgagctgccgcctcatcttttataagtaaatcctggctcttgatcgtcattaaatcgtttttcaagtattggtctcccattaaaagtctcatggcctgagcgcggatcgatttttcaatcacgtttctgacaaagcgcccgttgctgaatttaatggggcttgtcgtgcttttcactgtcattaagtaatcttttaacttccactcggcttcctggcttaattgatactcccgctctgctatcatgcgctttgcgatgtccatcagctgagtgacagagtaatccggaaaatcgatgctgatagggaaacgcgattgcagaccgggatttaatgacaggaaatgtgtcatttctcttgagtaccctgccaggatcagaatgaattcatgctgtttgtcttccatatgtttgacaagcgtatcaatcgcctctttaccgaaatccttttctccgcctcttgcaagtgagtatgcttcatcaatgaataaaatgcccccaagcgattttttaatcagatctctcgttttttgcgccgtgtgtccgatgtattcaccgacgagatcggcacgttccgcttcgatcagatgtcctttggaaagaacgttcatctcgaagaaaagcttgccgatcagtctcgcgacggtggttttcccggtgccggggttccctttgaacatcatatgaagagcttgttttccgactttcaacccttgttcggcccgtttttggttgacgaatatccatgcgtaaatttctttaatgttgcgtttcatttcttccatacccactaatgtgttcatttctttttcaatttctttcagaatgctgtgcttggcttcatttttttgcagggcggcctgatattccgcctcagcttctgcatttgtcagcacttgcttttggccattaagaatgatgttaatttgtccgttatttttataggttacagcgcgctccaacatgctcacctctctgttctctctttatcttactcatgatgaagcggttctgtgacatccgcctatcatcatgaggcccgttttcctctttatctgtcactttttccgttctcttcgggaatgatgttgaatcctgcgctttcccgagaaatatttttcatttcttattgtattcagcaaaaacgggaggacaaaccatttatttttattttccgggaaatgttgggtgtatttctcatttttttcatgaatgacagccgtacaagcaccttttgaatatcatcatatgctgtaatgaggtgatggagaatggttaaaatttttatagaccccggtcatggcggaactgattcaggtgcaaccggaaacggacttcaggaaaaagcggtcacgctggagatcgcactggctttgcgcacgattctgacgaatgagtatgaaggagtttctgtcacgatgagcaggacaagcgataagacggtcagcctgacggaaagaacggatgccgccaacagctggggcgcagattattttttatccattcatattaactcaggaggcggaaccggattcgaaagctatatttaccccggtgtcggagcgccgacctcgacttaccaatcagccgtccacacgcaagtaattcaagcatcgggttttaatgaccgcggaaaaaaaacagccaacttccatgtgctgcgggagacaaggatgccggcgattttgacggagaatggttttgttgatacgtcagctgatgcaaacaaactgaaaacagccagttttattgaaagccttgcaagaggacatgccaagggcttggagcaagctttcggtctaaaaaaaaaggctgacttatataaagtgcaaatcggcgcattcaacgtgaaagcaaatgctgatgcgcttgccgccgatgcggtgtctaaaggttttgacgcgattgtgcttccaaaaggcggcttatttaaagtgcagatcggcgcattctctttcagagattatgctgaagcgttggcagcgcgggccgaaaaagccggatttgatgccttcattgtgcaagactaaatgaaaaaacccctgctctccctttttgggacgaacgggggttttttgttattgaagtatatcggcgacaaaccgagaccaagcttcaagacgatgatacacattttcctctttcagttcgctcagtttcatccagcgcccggcgatttgatctttttctttcacttcgacttgtgctgcaggcgctaactggagcgcagaaaggatgccgatatgcaccttccctacatcgttttcatcatcattgatcaggccgagtgtgacaatgttttgtttgtcctcctcgcgaatgtacaattcttccgccagctcccggtcggtgttctgtttcagcacttccaaaaatgaagccgccccttccatagggttcatgtgtccgccgaagccgagagaaagcttattatggaggcgcgattcccctccgcccgcgagccgttcatacacaaatacctcatcatcgcggcggatgacgacatacggaatcggctgtttaaatcgcgggtcctcttccgcgtcgcctcttctgatttcaaaaaaatgcgcctcaatttgagccataatttttatgatacgttcatcctcgctgttgactccctgaaatgtcagcatttcgttttgaaagacgtcactccgcggtgcagccaagatgatttcatccattttattcatgcccgttcctcctgtcttacctctccactcaagccaaaagagcagatattatatctgctcttcatcttggccaaaataaaaatcttcgtccttaatcggttctaccgtcgcctttttgtagccgttccctttcatggagaagaaatcatgtgattttgttttggtgtttaatccgtttaatacaatcggattaatatcctcttcttcaaagtaaggatcgaaccctaagttcatcaaagctttattggcgttatagcggatgaatttctttacgtcatgagacagcccgacttggtcgtagagatcctctgtatattcaagctcattgtgataaagctcttctaaaagctcaaccgcaaattcgcgaagttccgcttttttcgcttctgtttgtttattgaatatttcctgggccagcagtccgacatatacaccgtggatcgcttcatcacgaagaatcaggttgatgatctcaccgctttgcatcagttttccctgtccgtaaaaatataacggataatagaaaccgctgtaaaaaaggaagctttccagatagacagaagcaaccatcgctttgaacagtgaaatttcatcatctttttgaatggctttgtaaagcccgacaatcatttgcgcttttttctgcagatatttattctgctttacccattcaaatacttcgttgatcgtttcagtcggagcaagcgtcataaaaatatttgaatatgattttgcgtgcaccgcgttttccatcatcgccatgaaattaagaaccgcttttcgctgatggccttcgacgtgctcggccacaatcggcatgcctgtgttcccctgctctgtatcaagcagtgtcaggccggcgagcaccttcatgtacgtatcctgctcatttttacccaaatacttccaagtaagaagatcgccgtttaatgcgatctcttccggaagccaaaactgctttacgttttggttgtagaacatttgggtgaaatcatcttcatgctttgaccagtttgctgcgtcataaatttttgtcactgttaactctcctttaatcaaacgacacaagaaagacagctgtcctgcccggtatctttcgttcttgcatagtaaatggttttgatgcctctatggtgggcatacagatcaatacggttcagatcacgagttgtcatcgtatctttcaaaaacagggtaaagctgattccctgatcgatatgctgctggattgtcgcgatcatatccaccactttgaacatgtccatatcataagcttctttgtagaagaaccagttattagacgctaaccccggcatcgggtaatacgtttttgaatttccgtatgttctttcttcgatccgttccatgatcggcataacggacgccgtgctggattggacgtaggaaatggagcctgtcggcgcgatgcacagtctgtagctgtggtacatgccgttttcggcgacaaacgccttcagctctttccagtcttcgattgtcgggatgtgcatgccttcaaagagcgcagcgattttttcgtatgccggtgagaactctttttcgatgtatttattgaaatattctcccgttgcataagtggagccttcgtaatgctcaaacgtttcgcctttttctttcgcaagctcagctgaacgctggatggaataaaagttcaccatcataaagaacgtattcgcaaaatctcttgcttccgggctttcataagcgatgccgttttgggccaggtagccgtgaaggttcatggcgcctaaaccgatcgacttcatcgctttgttcgcgcgtctgactgccggcgcgttgcggatatccgtcgtctcagatacatgagtcagggaatccgtcgcgagtttcaccgtgcgctcaatcgatttatgtttcatgacattcaaaatatttaatgaaccaaggttgcaggaaatgtccaggccgatttcgtcttcctcgtcataatctgtgtaagccgaaacctgtgacgcctgaagcacttcagagcaaaggttcgagaatttcacttttgatacgtggttattcgcatgctctttgtttacgttgtcctggaacataatgtacggataacctgactcagaacggagaacggcaagcttttcaagcaatttgcgcgcattcactttttcttttttgacacgcgggttgtcaacaagctcctcatacatcgccgtcatgtccatctcatccatatgctggccgtattctttataaatcgtgtgcggatagaatacataagccgctttgtcctcacgtgcaagctcaacgaacttatccggaatgacgacaccgatagaaagcgttttgacgcgcacatcttcatccgcagaaatctttttcgtatcaagaaagtcattgatatcgcggtggaaaatgtttaagtacgccgcgccagagccttgtctttggcccatttggtcagcgtaacggaacgcgttatcaagaagcttcatgacgcctacaacaccttttgtggcgttttcaacatctttaatcgcttcacctttcgcgcggagcttggacaggttaagagaaacaccgccgcccagtttagaaagctgcatggaaatatcgatcgcccgtgaaatatcgtttaaggaatcattgacttcgagcaagaaacagctcaccagttctccgcggcgttttctgccggcattcaaaaatgtcggtgtgctcggctgatattcctgattgatcatcagattcacatattcttttgctttctcagtgtcgccatttgcgaagaacagcgcaacaattgagatccggtcctcataacgctcgaggatttttttcttgtcattcgttttcaaagcatagtcattatagaatttaaacgcactcatgaaggaaggaaaacgaaacttcttagcgtaagctgtcttaaacacttctttaatgtcttcaaaagaataaaggcttaagaattcctcttcgtagtattggttttcaatcaaataatccagcttctcttttaaatcgtgaaagaaaactgtgttttgattgatatagtctacaaaatagctatgtacagcctctttatctttatcaaactggaattttccatcttgttggatcatgatttcgttatttaactggatccattttggcacttgattttgtgacaactctttctacctcctgagtaaacaattcaacgtctttagatgtgccgctgagttcaaatttgtgcaagatcggcacctgatattgtctagagatggtatcggcgctttttgcaaagttatcgccccatactttgttgccgctcgcagcgactcctaataagagatgggcgtatttttcgagaaatgattgtgttgatgccggtacctgaccgaagtttgtcgtgtaggtgaccaaaacaaacggagtgtccacgtggtccatttcgtccaccttgcggatcagctgaaagtctgttttattcacaaaacgctgaacattccctgtctttgaatcaaatatgatttgaaccatccttatcacgacctatcaaaaataatgaatctcttaacactatatatagtatactaacctctcagaaaaacacaacatattgagatcgatttataaaaaattcatatttttgaaagagcggactttggctccggcccgattaacgcccaaaaaagagagcagaacgagaatcatctctcatcctactcaaggtgtcatgtgtaagccgatgtctatcataacatgaaaaaaaactgcttagtagtctagacttttattcttattttttgtaagaatcacattttttttcgctttcaacggtttcttcaatctctacatcagcaccgatttctttcagtacggctttcagagcgcttgtgatggaagcctccctgatcagttctttgccgtcaacgatgatgctggttccatattcatagcaggaatcatcttcacaagtttcttcccaatggttgattatcaccttgtgtttcaatcgtctcaccctctgcatgatcaatgtcagtacttagtgtagcttgtgcggcccgctttgtaaattcgaacgcttgtgaaatttattcaagctcatccagcgccgtttcttttttcagttcgattttattcgttttttcatcatagcggtatatttttagataaccgccctcgacaatgccgaaacgattatgttccagctgcaccatgccttctgtctgcgattcggcatccgccaagccgccgtcatcatccgtcaccaccgtctcgtgattgctgcaagctccaaacagcaaaaaaacagcgatccaaacgagcgtaatcctgattcttctcagttcattttcactttcgaacacgattttccgaacccccttttatctttccgatatacggcctgcaatatacagacgcgcatagaaaaagaccattgttcatggtctttgtcaaaaagtctattcaagctcaagctggacgtttttttgcggggcgaacgtggagatggcatgtttataaataagctgctgcttcccctccgtttcgagcaaaacggtaaagttgtcaaagccttttacctggccgcgaagctgaaagccgttgagtaaaaacaccgtgacgaacgtattgtcttttcggatttgattcaaaaactgatcttgaatattaatcggtttcatgtttcgtcctccttggttctcaatacaatactgtttcgattaaatttccagttttcctgctatgcactcgaaaatttccttttttttctgctcaatatcaacaggcggcgtcatatctgtccatgaaacgggcattttattgcgaaaccaggtcagctggcgtttcgcatatcgccttgaattttgttttaattgctccacggcctgaggaagcggcacttttccatcaagatattcatacagctctttatagccgatcgcctgaatcgattggctgtcccggatattcatatcatacagccgctttacttcgtcaagaaggccggtttccagcatcaggtcaacgcgctcgttaatccggccgtacagtacttctctgtccattgtaagaccgataagaaccgcattgtaaagcagctcccgtttttgggttttaagatgctctgacattgtttttcccgatacatgcaggatttcgagcgcgcggatgactcttcgcgtattgttttgatgaatggctgccgccgcttccgggtcggctgccgcaagcttggcatgaagcgcttccgccccttcttcagccgccagtttctccattcgctcccggaatacagggtcgccggagttttccgtgaacgtatagtcatacagcacggactgaatgtacagacccgtccccccgacaatcatcggcagctttcctctaccggcaatctcggtgatttttcccctcaccattttctgataatccgccgttgaaaaagtgtcggacggctccaaaatatcaatcaggtgatgcggcacgccttctgtctcttcttcggtgactttggccgttccgatgtccatccctttatatacctgcatggaatctccgctgatgatttccgcattcagcattttcgcgagtccgatgcttagttttgtttttccgactgccgtcggtccgacgagtatgacgacaggctgttttttatttttcaatatgtatcactctcttttataaatctccccctaattatagcattcatttcttcaggcacctatccattttgccctttttcctgagcgctaaacgtccgctaccacccgatcggctcgtttccgacaacctctctcgtttttcctttgagcgtatggcggtgcgttttccgtccttcctcccgcggatcgtaaacgacgccgccatgctggatccgaatcggctcattgtaggcggcaaaggtggtctctgaaagctcatggtaatgtgttccgtcaaccctcgggatggcagggccggaaatgccgtaatacctatgaaaatggccgttttcaaacgaggtgatgcccgtatagaaatgtgtatgctcatctgtattgctgccgttctccggctgcgaaaagccttcgatcatatggtagtgcccctgcactacatccgtaacagcccggtatgcgtgtgtgtgcggaggtttttttgaccaatcggactgatacaggcccacaaaagctcactcctttatttttttgataaatgcccaatcaaaaattggtgggctgaatactctgttatcatctcaaatttattcttggaggtacctaaattatgaatgaagaatacacatatgcagcagatagtgatatgagaccgtttggacggcccggatttgggtttggacggccgggcttcgggttcgggcggcccggattcggcttcggcttcgggcggccgggttttggatttggccggccttggtttggttatggattcggacggccgtttggtttttacggcggaccgttcttcggagggcttgtcggggggcttgtcggaagcgctttattcaatccgtacctgtacggaggttacggctacccttactatccgtattactactaagacaatcaaaaagggctcctttcaggggcctttttatataggcctaatgtcttgacttggcgggcaaagttcggatattattttattttactgccttaaacaaaaggcataaggattatgatgagagggggatttgatatgattctgggttatatcttcctcacaattgctattttatcagagtcaatcggcgcggccatgctgaaggtctcccgcggatttacgcggtttttgccgagcgcgcttgtagtggcaggctattcattggccttttatatgctttcacttacactgaatctcattccgctcagcttatcctatgcaacatggagcggagcgggaacggtgctcgcatccattatcggagcgaaatggtttcatgaaaaactggacaagcaggccgtcatcggacttgtattcttattggccggtgtcattctgatgaattggtagaaaggagaagcatgatatgaaaggattactctgcctggcattagccattgtatcagaagtgttcggaagcacgatgctgaagctgtcggacggttttacgcacttatggcccgctctcggcgtcattgccggaatcggagcctcttttatgtttttgagcttctctttgaaaagccttgatttatccgccgcatacgcgacatggtcaggtgtcggcacggctttaacggcaattgtcggcttttttgtttttaaggaagccatgacagctaaaatgatgatcgggcttatttttgtcatcacgggcgtcatcctgctgaaccgttccaagtctcaaaaagctaaaaaaaatcaaacggcccggagctgaccgtttgaactcgtcaagcgcgggcagcttttacttcaacctcaagctccatctccacgtttccttggaccgctcgtgaaatcatacatgaggactccgctttttgcgctaacttcctggcgagcgtaaagtccgtttcggctgcatccggctttaataatataaacgggcggtgaatgattttctggtacgtgaacacaccgttcgtgacgtctacaattccttcagattccatatgtagatcttctttatccaggccgcttctttccatcatcgccgcaagcgttataatataacaggtcgcggccgctccaagcagcatttcatcaggatttgtgccttctccgggtccgtccatttccttaggaatggacacagcggtttccagccggccgcttttaatatcgccgacgtcattgcgatttccgggccaatttgcttttaaataaaagtgatgttttgccaagggacaaacctccttttttttcagtttactcacctttcactggtttgtctttttttaagctcacgaatactcttgattgatcactctttttatcgtacggacaaaccggtaaaattcctccgtttttgtgaattccctttcgcggtaatcaaaattatcaaaaaacgcctcccgctgttctctgctgatctcaagctgtatactcagcccggtttgcgcctggttattgatattttcggtgtcaaccccggccagaccggtttttgaggttgccaattctgcaggaaatccgtttcgtttgagagctctcaccaattttttcgcccgcttccggtcgcttcctccgacaagagtatttttctcgtcgcctttataaccgtgaactgcgataacataatggtgctgcttaatgctttcgactgctgaaggctcatcgaacttggtgctcgtaatatgaagagtctggttatcatgcgcttttaatccctcaaacaggtaggttgaataatcatccctgaaagagcggacgatctcgctcaccccgccctcaattctccctccgtgcggggacatgatcaatacggggctcccctttctcttattgtacgatatatgataatcatcggggtcttcatgttcagccagatctttaaaatctgtgtatgtatcagaagaattcgagggatcagggtctgacgcataatgagcacatcttattagtaagaccattgctacgataatgatgacattaagtaaaattcttttcatcagctctccttctttgctcctttctgaaaaatgaaatattcattatatggatttttgtcaataggtcttatcttaacattctattaacattatcatcagtgaaaaacttcccggtttcgaaaaatcaatggattgtcacggttcaagcgctcaaatgccgggcatcagtgaaaaaaggttgagagagggcaaaaaaaaagggaggaacgcccgaattttcaggggcgggagattcacggccggaaacggacggcatcaagaatacgcttttagaaatgaatatccgcctcccgaagcaaatgcgcaggacagaatggagcccgtcaaaaaagttctcatctgcctttttgtacagcaaaatgccgttacagcccgctcatcccctttttttatcataatggtccgttttgaaacggagccgtcttttttcatatatataatatcaatcggaagctgtttttccaaggaatgtctcaatatgatgttcatgtatatactcctttccgccggcttcatcacaaaacgaacaaacgttccgtttcgactcgatttcttctcctgaaaaagccgcaagtaaccagcgctcctgaaggacaaacaaactgaccgaacttacggcctgttcatatggtataaagagaatcgccagaatgggaggaaaagtatatatgtttggttactcaatggtacaaatggtgcggtcaaatgctcataagctggactggccgctcagagaaaacgtattacagttatataaacctttcaaatggacaccttgctttttacacaattttttcgaaaaaaaggtgaaaaacagaaagaaaatgtcagtcatcattgaatttgaagagggctgccatgaatccggttttcacagcacaggacaggtcttatcaaaagaaaaacgctgcactataaaaaagcagtttcaaacaatcaattgctgcagcgccgaagtcactccgtccgcccttcacatgcttctttcgcaatgccgggatatccgtaaaatctatttaaaccgtgaagtaaaagctctccttgatacggcagctgaatcgtctcatgcaaaagaagtgacccgtaacggcaccgtattaacaggaaaaggcgtaaccgtcgccgttattgataccggaatctatcagcatcccgatttagaaggcaggattatcggatttgcggactttgtcaatcaaaagacagaaccgtatgatgacaacgggcacggcacccattgcgccggtgatatcgcaagcagcggcgcttcatcttcgggtaaatatcaggggccggcgccggaagccgatctgatcggagtcaaggttttaaacaaatcaggatcaggaaccttggctgatatcattgaaggtgtggaatggtgcatacaatataataaagaacacacaaagaatccgatcagaatcatcagcatgtcactgggcggagatgcgctcagatatgataaagaaacggacgacccgctcgtcaaggccgttgaagaggcatggaatgaagggatcgtcgtctgcgtcgccgcgggcaactccggtccggaagctcaaacgatttcaagccccggtgtcagcgagaaggtcatcacggtaggcgcctatgatgacaatgatacagccagcaatgaggacgatacggtcgcttctttctcaagccgcggcccgacggtgtacggaaaagagaagcctgacattcttgcgcccggggtcgatatcgtatctctacgttctccgcgttcatatcttgacaaattacagaaatcaaaccgtgtaggctccttgtatttcagtctgtcgggcacgtccatggccactccgatctgtgcgggcatcgctgccttaatccttcagcaaaacccgcagctttcgcctgacgaagtgaaaacattgatcaaacaaagtccggatcaatggacaaatgaagatccgaacatttacggagcgggcgcagtgaacgctgaaaatgctgtgccgaaagagtaacctttttatcatgagaacggggtcgtctgcacggcagatgactccgtttttcaggtgaatagatgaaacatttataatgaaggaactcggaacagttcagaaccggctgtcagaaaaaaagatcaatgcaaggcggtgtatttctaaaaaaatagggaataagtatggtgtagataaaaggaggaatcacaatggcacttacaaacaccgaattgtctgaatggctgcaaaaacagatcggacaaacgcttgatatcagaaaaggagagctgacagacagccgaaacgagatttctgatatggatcagatcatgcttcaccttgatgacgttctcgtccgccggacaaaccatcccgatgactatgtagcggatgaagaactcgtcttaaaagggcacggcacaacctatacggaggaaggaaatgtcccgcttccccaagatgcgtatgaaattcctctgctcggcgacattaccatccaacaggagcaagacggattaaaggtacatacagatcgggccgtgtatacaatcgggacccggaaagagcaataaaaagaaaaaacgccgctgattcagggcgtttttttattgtttttttcttcagaatatccgtggaacatcgtgaatgcgcaaagcataatgcctaaaataatgataatcgggagccagatcacggcaaacttataatccggttcggcaaaagcgcctatgaccgccccaaagcaatacagaaccaaggcaagcgcgcgcaatacagcatctctcgtaaactgcttccgcttgtccgctttgtaaaaccttgcggtgagatcttcaaaaaaattagcgagcgttcccgttaatacggtcgtggaaatccccgctacaccaagttttctcgcggctgtcgtctgcattcccattgcgaagctgagcagcataatcagcacataaacagaaatggcgtctgcaaaaaagcaggagaacaaagcaaacagcagcaaaacagctccttcaatagctaaagcggcagttaccgcagggggccagaatgatttctttttattgcccacaagcagggccgcggcaataacgccggcaataaatccgattaacgaggttaacgatttgagtacggcaaggtgccatgagttgccgatcgccaggccgaacagaacgatgttccccgtcatattggcggtaaagatatgtcccaggcttaaataaccgatcacatccacaattcccgctgttaaacaaagaagtaaaagtgcaatatttcggtatgtagtcactgtcaatgtgatccaatcctttctcatgctgattccaacatataagtttactctttgccatttcatatgtccagccggcgtgccgctttttcaaagcataaaaaaactccggcgaaccggagaagttactgaacgataaataatactctcgtgccgtcggaatagccgctcatttgatttccaacccatgaaccggccccgcggttatccgatggggttacatatctgatatcagcccccgccccgccttctgtgcagactgccatgggccattcatcacggtcaaacccgggctttgtcggaattcctttcaatgattctttccttctgttctccgctccgccccgatcaattgtacaaatctcagaatgacctgccgaaatggcggcttttatatgatttcccgtctccggatattttgacagcgggaaatacagcacctgatcgtatcgggatgcagcatgagcagcactgtccgaatggatgccggcgcccgtaaggccgaactgaagagagatcaccaaaagcagacttgccgcccatttcataaacgcattcattcacatcctccttaagaagttgatatgaagcgtaaatatgtatattagccggatttaacacacatgatgaaatggcaaaaaaagtttgctgttttgttgataatcaacgaaaatggcggctttacgatttgtctattgaaccagcttctgtttccttatatattttagacatacttatgagccgttgtgatcagtgtcttcggcagataaaaggaggaatgccgtccggtcggcaggcaccggctgttggttatgtcttttcaaaaacatgaaggcggggaaatccagatggaaaaaacaatgtttcacccacactcacccgagtttcacgaagacccttttgcggttttaagcagattcagagagcaggaccccatacataaattcgaactgcagcgtttcggaggcacctttccggcatggctcatcacgcgttatgatgattgtatggcgtttttaaaagacggcagaattacgagagatgtaaaacgggtcatgccgaaggagctgatcgcgaagctgaatgtcagcgaagatatcgattttgtctcagagcatatgctggcaaaagaccctccggatcattcacgtcttcgatctttggtgcatcaggggttcactccccggatgattgagcagcttcgcaccgggatagagcagatcacagaagagctgctggatgaaatggaaacaaaagcagaccctgatatcatgaaagatttcgcggcaccgcttccgtttatcgtcatttccgagctgctcggaattccgaaagaggaccgcgccaaatttcaagtatggacaaacgcgatggtcgacacgtcagagagcggacaagatgcgaccaaccaggctctcaaagaatttaaacaatatatgaaaacactgatcgaagaaaaaagaaaacatcccgctgaagatctgacaagcaagcttatttacgctgaagaggacggccaaaagctgagtgaatcagagctgtattccatgctgtttttgttagtcgttgccgggcttgaaacaacggttaaccttctcggctccggcaccctggcgcttcttctgcacaaagaccagatggagaagataaagcggcagcccgaaaatatccagacggcggtcgaagagcttttgcgttacacctctcccgtcatcatgatggcgaatcgatgggcgattgaagatttcacctataaagatgtttctattaaaaaaggcgatatgatatttatcggcatcggttcagccaatcgggacccggaatatttcgatgatcctgatacattaaatatagcgagaacaccgaaccgtcatatctcttttggattcggcattcatttttgtctcggggctccgctcgcccggatggaagcatccattgcctttacttctcttttaaaacggtttccgaatatagagctgaaaggcgcgcacgaggatgtaacgtggagaaaaaacgtgtttttgagagggcttgaaacattgcctgtcagattttaatatcgccccctgtttatcgggggttttttaatatcttataaactggaaatcaatataatagtgaatatttagtacgtagtgtatttagttctatttgtgaaaaaagcggccggattgctccggccgttctctattaccgttttaccaactcatttgtttcgtccagcttttttttgaaagatttaaggaaatttacgcttatcgttcctttgtttgcgtacagtttttcgcagaatgccttaatggcgttttgcggctttggttccgacagcattgtgacatgattggaagagtggacgtccagcaggtgaaagtgtttcatctggtgttcccattctttccaatacgcaacatggtctaacggaatttgttcttcctctgctgtcagataacgttcaaaatctccgagaaacaaaccgcttttattacggaagtagtaacattgcagcgcttccggatgaggcagcggcttcatgtcatactcttccattccgtaagcgagctgcgtcttcatcatttgctccagctgcatccggatcgcttcttcggattttggcagaccgcgctttttggcaaggccgatcaattctttcaatacttcttcttcctcagcctggacggtaatgtcttctctgctgattaatgcctcttcaaggttttcaggcttaagatatgccgtaagcatcgtattgatcgtttgcagcatgactgacttaacagatggttttctctctttccatttttcactgtacggggtgtcgatcatgacggcgctttttactgtatgaccttcctcctgcaagaggcgcgcggtttcataagcaagcatcccgcccaaggaatatccgccgaggtcataagggcctttcggctgtaccgcttggatgattctcatataagaagcggccgtctcttcgattccttgcagcggctctttccctgtcaaacctcttgcctggatgccgtaaaaaggacgctgactctttttggcgaatggctggtatgcttcaacgcctcctgttccgccgtgaaaccaaaaaacaggacggcctttttctctttcattcagcttgacgagttcgggaaaattccggcccgcctcatgcggttggttcgtttttaacagcatgccgatctcctgaagagtgctgcatttctgaagagcttccagactgatccggctgtctccgtcctcaagttttttcagcagctgaatagaggagattgaatcaaagccgtattcagtcagcggcttattttgatcaatttccgctgccttcatccccaaaatgtcagccacaatgtcagctgcgctctcgcggcggagctgagggtcctgggaaaccggcgcaagggtgatgtcttctggctgaccgccattccaatacttgtggtgttcaaaaggatatgtcggaagcggcactctttgaacagatttgccttggtggagtctgtcccacggtatatccgctcctttcacccagcaaaatgcaagcttttccagattgttttcagccaacagcgtctccgtgacgactgtaccgagagtcccttccagtaaaacgccgatatctcctgatccagtctgctgactgcctgtaaagaagcttttcattccattgctttcttcggaaaatgctctgtactctttcagtttttccagcaattcatcttgattgcgggcaacgagtgccaagcggcagttcatcgcctcacggccggtctgaagcgtataagcaatatcccgcagtgacggagtatctccagtttgcacaaaatcagccagctgacctgcggccgccttaagacgcccttcgctcttagcagaaagcacgataagctgcgggtcatgcgcagattctttgtctttatggctcggactgtactgttccaagacgacatgcgcattcatgccgccgaagccatagctgttaattgcggcccggcgcgggatcggtctgcccgtatggtcggtgagctgtgaccattcctgattgtcttcggtgaaacggaagcggcttttttgaataaccatttgctcatttgcagctgtaaatccgggaatacccgggatggtatgatgcttcatggccatcgctacttttataagggcggccagtccggaagcgagttcgccgtgcccgatgcaaggtttcacggtgctgatataacaaggcgcgctttcctcttgatttgcagactcgccgtaacccgctttgattgcattaaactccagcgcatctgccatttcggaggcaatgccgtgcgcttcaatataagtgacggtttgcggatcaacatcggtgtcttcgtacgcttttttcatcgcggccttcattcccgccggattcggtgcgtgaagcgacatgcctttaccgccgtgagacactcctgttcctttaatgaccatgtgaatatgatcgccgtcttcaattgccgcctcaagcggtttgatgataataacgcccgccccttcgcttctgacaaagccatcggcatctttttggaacgatttcgcccggccgtttttgcttaaatatcccatcgagtcaaaaccgataaaacctttcggcgattgcagaatattggcggcgcccacgacagcctgctcacattcgttatgacggattgattgaaccgccctgtgcaatgccaccagcgttgacgtgcaggcagcctcgtaatattcactcggtccatgtaaattcaaggcatatgatatcctgttcggaatgatggacggaatggctgttccattgttcggatcgctgttgcccgcggcaacgaaaacgcctgtcggtctgcttgataatgccttatttgtcaggcccgcatcctccattgccttccatgtatgcatcaaaagcagaaactgctccggccccatttgtgatgcctctttaggagaaattccgaaaaagagcgggtcaaattcgccgacaccgtcaataaaaccgccccatctgagactcgtgtcattctcatcgccggcgtaacggcgccagtcccagcggtccgccggaatttcggtaatacagtgatccccgtttacgatgtgcccccaaaaagactggatatccggggattgcggaaactgagctgacataccgataatcgcgattccttgcttgacatcggcgttttcacaaggcgtatgctgtttcttcggtaaagtgcgctcttctgtttccgtgaccccggcctcttctgaatgcctatgatcggcaagcaattgagaaaacttgctctcatatgctgacacgaagtggcgggtcagctcctccgccgtcggatactcgaaaaacaatgttggattcacatcgatgtccgcctcttggccgatctcttttgtcagcccgatcagactcgctgaatcaagtcccaattccatgatattcgcattagaacgaagagatgacgcgggttcatccatcatcttggcgagcttgccaaggatgtagctgcggatatcatctgtcagactgccggcagaaatcggtgctcccgcattcttaacagccgttcgggccggctgattcatctgttcggttttcgggcggaaccgtttcagggcatagccttcaaaacgcatcaccacttccgatcggctgctgatgacatctgcgttaatcagaatcatttcccccgtttgtttagccagcttgatgtgcagccagcaatcggtaagattttccgggctgctgaaggtgacggaattaatgccgaacggcagatagctttccgtctctgtttggtccaataaagaaagcgaggccaagtaagcactgttggcgattaatggatttatggcataatgatgcgcttgttgtgagtcgctattgttcaggttcactttcgctaaaacggcatcagtgcctttgtacagacgggtgatcgttttaaattcttctccccacacgacggttcccgttccatctccgtataactcatctatccggcccacttcccggtaagagcgctgaatggccgccagatctgcgtgctgcttttgaaacggatacgggctgcactcggcatacgccgctatgctccaatcaggagacgtgcggctgcggtgcattatgctcagttcaaatccatccccgttttgtttcgattctgttttcagctcgatgtgatcgcctttttttacggtaatggggctgacgtaattcagttttttaatatgtcctccttccgcttcaggaaaaaggtcacaaaaatgatcgactgccagactgttatatgtagcgccgacgagtaccggttctccgccgaattgatgccctttcacgtatgggtcgtcatcactgtataccgcctgaacgccggcagcgttttctgattcaccgaaatgaaaagaagtcccgtggtcaaaagcgtaggccggcagatgaacggcgtgctcttgctgcaactgatcaaacgtgatattctctcctttttcccattgccgcgcacgccggccgatatcagaatcggagaaattgagattccgctgatccatgcggtaagcggccagtttttccagcagttcctgaacggaagcagccgtaaatgccgcccgatactccggatgatgcgttcttttttgcagcgcagatgcgatggcggccggatgaagagatggcgtcttttctaaaaaggccgcaagtctctcaagataggcttcaaaactccattttgttttcgctgacacagggaaaatatattcctcatcgccgtgacgggcctgatcggaattcgggctgatatattcttctacgatgagatttgcatatgccccgcctgccccgaaggaattgatcatgcttctccgcggtacgatgtctcccgtctcggcatccttcagacgctcccaatactcggttttctcctgcaggtaaaaggccgtttgttcaagcgcgatattcggattttgcggttttgcgttaatggtcggaactaatgtttcccgctccatttgcagcagcactttcgcgagctgggacatcccggaggccgcctctaaatggccgagatttgacttgacggatccaagcgcgcaaaatcgttttttatcggtatattgcgagaacgcgttcgtcagggcaatgacctcaatcggatctcccaatacagagccgtttgccgctgattcaacataactgattgtttccggattgattccggctttgtcaatggaagccgccatgagcttcgcctgctgtttcggatccggagccgtgtacatctgccttccgccgctatggcacaacgcgctgcttttaatgaccccgtaaatatggtctttgtcggcaaccgctttggagagcggcttcaagagcaccgcaccgactccttctcccggcatcagccccgtgccggttccgaagcttttgctttcacttccctgttcaagcaaattcgcccgttcgagcgcatcatatttagacggttcaagcgtgagattgacccccccggcaatcgccatggaacagctgttaagcttcaggctttcacaggcgagatgaatggcgctcagtgagctggagcatgcggtcgtaacgcccatgctcgggcccgttaaattgaaaaagtgggaaatgcggttggcgatatgccaatcccctccgttagagctgagcgcagctttttccaatgacgggatattccagaaatattgattgtacatactgcccataaatacaccgattccgctgtctgattcctgccattcgtttactctctctaacgagtagccgccgttttcaaatgtttcccatacggtttcaaggcttagacggagctcaggtgtcatctccatcacatggtcttcccggatgtcaaacaagtgatggtcaaaagcgtcaatatgctgcagaaatccgccgtaccgtgttttgcgttcttcttttcgtgtttcttttgccatcgttttcagaagaccggacttccatctgttttccggagcttccgtaatacagctgtctccggcttttaaatgctcccacagctcatcgagggtttcagactcgggatagcggccgctgatgccgataatggcaatgtcgtcacgatctgagcgattatcggtgacggtttctgtttccggctttggcgcttttggctctttttgttcagtgataaatcgccgcgtttccgtgacaagcggcaccggttcattcattgcaggttccggatgctccgtttcaggaggcgcttgatcggctccgaatgcctgttgcagcttatccgggtaagtttccagcaaatactcggcaagttctttcgtattcgtgtgttcaaataagaccgttttcggcagctcgcccgtcaatgtttccagttcacggataaaattcacctgcaaaatggagtcgatgccgtatttttcaaagctggtttccggctgaatgcgctcgggagcaagctttatggacttggctaacgtttcttttatgaattgcaccgtccggtctgtgactgagaaagacggttctgtgaaatcagccggctctttggaagccgcaatttcttcaaccgccggcgcgtccggctgcttttgcctgatgacgccgtcgctttctgctgccacgatctgctggccgaggtgatgtgacgattccgccataaatgtaacgtaccgatatccctcgctttccagcgcagactgccacgcttcaggatacagcccagggcatccgggaatacgcagtttggcgtcttcatacagccaccagccttccaaaagaccgaatgtcagatgagaataaaccgaatggctgctgatctcatttaatagcaaaatcccattctttttaagcaccgctttggcattgcgaagtgtccgccgaatattttttgtcgcgtgaagcacatttgccgcaattaccgcgtcatatgcacccgcctctataccctgcaaagccgggggctcttccacattaaaccgcttataagtcaaatacggattgtcgggaccgtattctttttcagcatgcatgaaaaaggcctttgacagatcggtgtagcaatattctttcacatgatgtttgacctcttttaatcttttgaaaacggccgcgctcgtcccgcccgtccccgctccgatctctaatatccggatttccgcgttcgggtcttctttcaggcgttcttcaatgaaagccgtcaatgtgtcagcgagcacctcattaaagtagtctgccgtttcattgtttttatagattccttcaaccaattccattgaggaatcaggaaacagaacatcagtggcagaaactctgccggataaaatatccggcaaagctctgagagcggtctccactaaggtgatcatcgcccgtttgctgctgtccttgagtaaaggagctttcttttcatcccattcttgccacagaacgtccgcacgctctatcggacccgttaacacatacgtactgccagactgtttcaaaaagcctttttgcaccaagatggagatgctttcttccagccacctgccgtaaaacccctgcataacaggctgcgtttcgttttccgtaaaaaatccgacagatttcagctggcctgccaatagtttgtaaagaagatcttcagtgttttgcaaagccgtcccctccttaactcaattgttgtacatgtcttgttactttaggctgatagcttcgcagtttttgcatcgccgagccgtgatgttcagggtatacttctatcatttcttccggtttttcctccggctcttccgcctgtttcatcatgacgaactgattcaatgggccgccgagcaatcgttcaagcgccgccattgcttccggcgcttcaattgatccgactcccgcctgtttcatccgttcttgatattcggcagatgatacgattccgacactgccccagtagctccaattcatcactgccgccgaatacggccgaacttgagccaaatgagcggcaaaggcatctttgaaactgcacccggcagcataattgctttgtccggccgctcgcgcaaatgattgaacagatgagaagaacaaagcaaagtccagcggctcattttggaacacgcgggccatattcacgctgacattgacttttgcagcgagcacgcttctcaaacggctttccggcatattcgccaggctctgatcctctaaaacaattgcggaatggatgattccgttaatttgcgggtgcgtgcgtttgatcgttttatacgcccgtgtgagctcatccgggtttgccgcgtcagcttcaatataaatcggcgccggcccgaattggctgagtctgtcgattttttcctggatggcgctgttatgttttcgtctgccgatccaaacgactcgcgcctgatacgttttcacggcatattcgctccatgcctcgccgatgccccccgcgccgccgatgacgacataaacgccgcctttttggtaagcgggccggcttgacaccggctgctgtacagggatgaggcgctgtttgtaccagtgattgttgcggtacgcccatgtattgccttgctcatcaaacggcgctgagaacagctccgcctttgaaacatcttccggacatccggcatcaatcagccgtgtttgccagttcggatactcttttgcgagcgaaccgatcaaaccgtgaatgcctgcatgagccggatcaatgatgtccgccggctgtacggactgtgtttttattgtgactgcagtcaagctgattcgcttgcctccatatcctaaagcaagcatcgccttaatcactctgtacatctggatgacgcccgcatcttgagctttcaccatgtcaccatcgctgtgaaaaggagcgatccatacgatatgcccgaaagaccctcttgctttcaattcagccgcaacagcctctatttcatcctccgggttgatatgaagccgtttcgcagaaggatgatgcaattgaaaagcctcgctttcctcatcccctgcgataaagacaacctcttccgtcttatatgccgggctttggtcacggaattccgcaagatcccataccggagccagaaggtttgctccatttaatgatgtttccggcgccgggccttccatcattctggaagaaatccctttaatcctgacacagacgcggcctgtctcatcgcataagtcaatgtccagccgctgtattttttcatccgttccccgagagctgacatacgcccacatgctggtcgtgcacgggctgaaaatgtccagttcctcaagggcgaacggcagtgacagctggttatcatctgcatgcagctttagtccgattgtcgcttgcagagctgaatcaagcatacacgggtgaagaacatattgatctgccgtttcttcgaggaaggaaggcagacggagctcagctaatgcttgattgcttccgatatgaatgtgctgaattccttgttgtccgggaccgtagtcaatgccgattttgctgaataagccgtaacactgttcagaagtcagcatactgaggccgcattgagctttcagtgcgcctatatcacggtgcggagcctccccggcgccgagaatgccggcagccccctgacagtgtatctgcctgccgcttgcttctatttgtgaatccgtgtaaatgtcatacacgatttcaccgttttccctcgggttcaggctgatttgcgcttcaatcgggcggtttcccgcttcgatcggccgaacccaaacgatgtttttcagacggatgacagacggaacttccttttgccctttgactgcctgagcaaccgccgccctggccatttccaagtaggcgacgcccggcatgaccggcttgcctttaataagatgatcggtgaaaatcgtctcttgtcccgtaaattcggatcggtaccgctgctctgttaaatccgatacattctcgtgaagcagcgggtgcagcacccgcgccgtcggcacagcttgcggtttttctgctttcggccggttgtccgtgatccagtaccgctctttcgcaaacgggtaagcaggaagactcatccgttggggcttgatatcagaatataagccgtcccatttgatatccgcgccctgcacccataattccgcaagcttgtcattctctctgcggcttatcagctcttcgatatccgcttcgccgtttgcgcctgccataatggatttcagcgggattttacccgcttttcctttataaatgcccgctttgtcataacgtcctttcgcacagctctttagcttgtcccgcagttctgcggccgaggaagcgataatggccgctctttcttccatcgcatcacgcccctgctgaagcgtgtaagcaacatcggcaagatccgcatccgtaaaagaagcttgcgccagctgctgcgcctgttcctgcagacgttcttcttctttggccgacagcacaaagatttgagggtgtgtgaaaacagctgtttttctttcttccttcggaatatattcttcaatgacgacatgggcgtttacgccgccgatgccgaaagaactgattcccgcacggcgcggcagatgattgccgttttcgtctttcaatgctgtccattctcttttttcctgtacgatgtaaaacggactgtctttcagtttgatatacgggttgacgacctcgctgtggaggctttttgcaagtgttttatgcttcatctgcatcagcactttgatcacacccgcgacaccggctgccagtgacaggtggccgatattggtttttgccgatcccaaaccgcagtgactcgcgtaaacggcgggatcgcctgttttttcgtacagcttttgaaaggcggatttcaggccgttgatttcaaccggatcgccaagctccgttccggttccgtgcgcttctatataagtgacggttctcggatcaatgcctgctttgtcataagccgttctgacgacttccgcctgggctttcgggttcggtgtcgtcaaggagttcgcgcgtccgccgtggttgaccgcgctgcctttgatgacgccgtaaatatgatcgcccgctttttccgcttctgacagctttttcaaaaacagaattccggcaccttcactgacggcaaatccgtccgccctgtcggagaacgttttgcatttcccttctttgctcagcgcacccgctttgtcataagcgatgtggccttgcggtgtgacgacggtattcacgccgccggcgatcgccatctcgcagttcccgttttcaatggcgcatacggcgtgatgaatcgcgaccagcgagctggaacaagccgtgtcgatcggttcactcggcccgtgcagattgagcatatagctgacgcggttcggccctgctgacggactcatatttgcggctgacgcaccgccgatatccaggtcggaaaacagtgagccgtatccggtattccccgtgccgatatacaggccggttttcgtgccggaaaggcttttagcggaatatcccgcatcttctatcgccttccacgcatacatcattaacaagcgctgctggggatccatctgttcggcttccagcggtgaaattccgaagaacagcggatcaaattccgcaactccgtcaataaatccgccccactttacatttgttttgttggcttcgttaagcgggtcaccgtaatactcccgccagtcccagcgatccgccggcacctctgttatacaatcttttccctcttctaaattgcgccaatactcatcaatatttgcggccttcggaaacactccgctcatgccgacaatggcgatcggttccggtttatgttcagccgcagtctgaacatgctgtacggctgtttttgcaaatcgtttgttccctgccagtctgatgccgccatcatctgttacaccgcttttcttttcttctttcggctgtgtgctgccggcaaattgcgtttgatagtcttctgctaaatgatgcgccaaggcttgaatcgtcgcatattcaaaaaatacggtcggtgtcagatcaagctgataagtgtcattcagcttgttggcgaattccgtcagcgtaatggaatcaaatccgtattgattgaactccaattcgatatcgatttcttcaatgtttattttcagaagcccggaaacttcttttgccagcaattcctgaagtttggccgtcaggtctttcggcgcaggtgtttcttccgttttcttaaccggtgcaaaagcggctgcgggagtcttttgaagcagtttttcccgcattacggcgcggtttccttccataacgagcacgcttgttttccccgtgctccatgctttgtaaagagcttctattccggtttcagtgcgcatcggcgttacaccggttcttttttcggtgagcttcgccatttcttcattgacttgcattccgccgtctttccaaagcggccaattgattgacaatgtgtgaccgtggcggtacattgccgtaaccagcgcgttgcggtatgccgcatagctgtccataaatgcgtttgccgccgcataatccgcctgtcccgcattcccggtgacaccggaaatggatgagaaaacgatgaaaaagtccagcgctaaatgctcggttgcttcatcaaggttgacaaatccgtccgttttaggagccaatacactgtaaaactcttcggttgttttctttgcgatatattgatctctcatcacacccgcgctatgaatgatgccgtgaaggccgccatattccgtttcaattgttttgaccaggtctgccgcagtttgagcgtttgttacgtcagcctgtttgtattccgcttttgctccgagtgattcaagcgattgcagctgcatccgctgattctcgcttaatgcggaacggcctgtcaaaaccagtgtcggctttttgactttccgggcaatttctttcgcgaaaataaagccgaggcccccggctcctccggtaatgagataaatccctccgtcgttccacggaatgcgtattttgccgccggacacggccgtttctttgacatctgcgctgtatcggatgccgttttcatatttgatatggctgtcatcagcccttgttttattttctctgatgatgcctgtgattctgccgttttccgccggttctatttcaatcagctgggttttcagttttttatgttccaggccggctgtttttaacagagctgaaatccctgagagcagctgatgcttatctgttttagagagaaccgtctggataaggacgtctccttccgtctcttccttcagcagtttttgcagcgtctccaatatccgtcctgtataatcacggaagcgcgccgccgctttcccgtgcggggaggtcatttcaaaatattcagctcccgcggcttcaaccgcttgttttagtccggcgtctgtgtcacaaagcattacgatatgccgggcaaaaaccggttccgtttgagcagcagtttcatcgcttcgggtccataccggctcaagcatgagcgtttccggagctttttcttttttctcaggttctttttcagccgttctgaatgacaaacctttcagccttacgcaaaccttgccgttttcatcacaaatatcaagatcgcgtttttcaacatgtccggctttgtggtcttcagaaagtctggcatatacccacatctcggcagcgcatgcgctgaatacttcaagctcctgaaccgcaaacggaagcatcagtttttcatcatttgttccggttaatatgcttgatgcctgcaatgcagagtccattaagcccggatgcatgacatactcctgtatcgtgtccgcacaagccgcgtcaagagacagtctgcccaatacgaaatcatcacctgtataaatcgctttgacacccctgaaagccgggccgtaatcaaaaccgattttgcggtacatatcgtacacttcatctgcagaaaacggtgtctcggcggattgtaatctcagtttttggagatcaatgaccggagcttttgcgtcagggcggactgatactgccccttggctgtaaacggacggctgatctgtttcccgaccgcagtaaatgtcgaattgaacgtcatttgccgtttcgggaatgagacggatgttgacatgaaccggctcgtcttcaatggtaatcggccgcacccaaaccgtattcttaagctggacgcttccttgtccggccggaacttcagatgcctgttccattgctgcgcgcgccatttcaagatgtgccacacccggtaaaatcggcacgccttttacaacatgatccgcaaggtaaaattcttctcctgtatagattgagctgaaccgctgttctgcaaggtttgaagtatttctgtgcagaagcggatgaagcgcgtcttgttttccggcagatacagtgcttgttttttcgtgttttccggtgtgtttcgccgcccaatagcggtcttttgcaaaaggatacgacggcaggctcatgcgtttaggcggccggtctccatacagcttcgcccaatcgacgttcagccctttgacccataattcaagcagcttcgcgtatttgccgcgtgccatccatttttcaacggcttcttgaatttcttcatcttccgtcagcatttgcagcgtgcctttgtctattcttcctctgtacaaatccgcatgcttatctccagtgataaactgtgacagtttttcctgcagttcttctgcggatccggcaataaccgccaggcgttcttccatggcgtcccttccgatttggagagtatatgccatagaaacgaggctggaatgatcgtaccgtttttcagtaagcgcacgtttcagctgttttgcctgctctttcaggcgtttttcatttttggcggacagaacgaaaagacatgggtcgatatgagaatcatctgcttcctctctgtcttctggaatgtattcttcgatgacgacgtgggcatttacgcctccgatgccgaatgagctgatgcccgcgcggcgcggctgttcgtttccgcgttcgtccgtctgcgtcttccattccatcgtctcccgcaccagataaaacgggctgtcttcaagctgaatatacggatttaccgtctcacagtggagacttttgactaatgtgcgatgcttcatctgcagcaaaattttaataatgcccgctgctcccgcggcaagggataaatggccgatattcgttttgaccgaccctaagccgcaatagccggccgctttctcttttccgtctgcaaacgagctgaacgcttgtttcaggccgttaatttcaacgggatcccccaattctgttccggtgccgtgcgcttcgatataagagactgttttcggatcaatgcccgcttttttatatgcggctttaataacttccgcctgttgtttcgggttaggcgttgttaaagatgccgcacggccgccgtgattcaccgcgcttcctttaatgacgccgtaaatatggtccccatccgcctcagcggctttcagctttttgaggaaaaagagcccggctccttcaccatgggcaaaaccgtcagcctgatcggagaacgtcttgcatcttccttctttactcagcgcgcccgctttgtcaaagctgatatacacatccggaagaacaatcgtattgattcctcccgccaaagccatgtcgcacgtcccttcttcaattgaagaaacggcatggtgtatggcaacgagtgagcttgagcaggcggtatcaatcggctcgctcggcccgtgcagattgagcgtatagctgacacggttcggtccgacagacggacttgtattcgccgcggatgacccttcaatcgccgcatcggcattggctaaaagagaaccgtagccggtgtttccggtcccgataaacacacctgtctttgtgcctgagagactctttgacgcatatccggcatcttcaatcgctttccacgcatacgtcagcaagaggcgctgctgagggtccatttgctccgcttcccgcggtgaaatcccgaaaaacaacggatcaaattcagcaattccgtcaataaacccgccttggttgacgtttgttttattggcttcttttgcgggatccccgtaatagtcccgccagtcccagcggtctttcggaatctcggtcatgcagtctttgccttctttcaggttctgccagaaagcttcaatgtcttctgccatcgggaaaatcccgctgatgcctacgattgcgatcggttccggcccttggtcccgctgcactgcctgcggaagtgtctcaggcagagtgcggcgtcgcttaacggccgggcgcgtaatttgagtctcttttaccggtcttgccgattgaatcgtttttgtatttaccgcaaaccgtccggcaaattcctcttcgtattcactgattaaatgaacggcaaattcatggattgtcggatgatcaaagaaaatcgtcggcgttaacgtaagccggtacgttttgtttaactggttcgtaaactcagtcatcgagatagaatccagcccgtattttgtcatttcttcatgaggatcaattctgtcaatgtttacttttaacagcgaggccgtctgctgttttaacagatgcttcactttttcaagcaggctgtcagcatcaatgtcatgacgtacgccgatctctgcttccggatgatcattctctttgcggaaccgttttgctttcatgtgtttcacatctccttcaaaaaccgtcatccgggctgtcccgctcatcaagccttgatataaagccttgatgccggcatctgtgctgagcggtgcgattcccgcctgctgcatcagcatatcttccgtctgctttcctgcctgcattccgccttctttccataacggccagctgacagaaagcgtctttccgtatctttgtcctgcggcttgtaaagaacggcggtactcggcatacatctccataaaaacatttgcagacgcataatcagcctggccgacgcttccaagcacacctgataaggatgagaagacaataaagacatctaatttctcatgttgtgacgcttcatcaagatacacaaggcccttcactttcggagcgagaacgtgttggaattcctctgccgtcttcttcaccatgtagttgtcttttataatgccggcactgtgaacaatcccgtccagcttgccgtgccgtttacggatattgcggatcaatcggtatacttctgcttcgtccgtgacatcggtctgctcgtagaaaacagaagcgccggcagcacgtactgtttccagcatgtctttctgcttttctccgagagcggaccggccggttagtatgatgacggcgtcttttgtacggtttgcgatctcttttgcaaaaatcagacctaaacctccggcacctcctgtaatgagataaacgccttcgtctttccacggaatgtccggctccgcttgagaaatattcatctcttcccaatcagcggcaaagcgcttgccgttttcatatttcacatggacgctttcggcatgcatacggttttccgccgctttttccgcgatgccttcagcactttctttctcctcggcttcgatcatttgacagatcagcttggaatgttcaagacatgcggttttgaagaggccggtaatgcctgagaacacctgctgtaagcctgttgaccgcgtaacagcctgaaaaagaacgcggcccttcggcttgcttttcattatggttttgatatggccaaacagctgacccgcataagaatgataccgctctgcaatagatgcgggacgatcgtccaggataatgacgcgtgcatgttcaagctttgcttcgacagcttgttttacggcttcatcgtactcacaaaggaaaatgatatgctcttcatacgaaggcgcgtgatcggccggtgccggctgctctttccagaccggttcagcgaacaatgtgtccgtacggctgaccgaaacgccggcacccgcgttttcttccatgatccgcgttgagaaacctctcatccgcacacaaagcccgccgttactgtcatataaatcaatatcggctttttggataggatcgccggctttattgttcgcactgaatgtgacgtgcacccacatatcatcagcgcacggattcagaatgtccagctcctctaaagcaaacggcaatgcggctttgaatggttccccgctttctgccagcagcgctctcgtcacgttttgcaaatattcggcggcctgaagcgcaccgtccatcatactcggatgaaggatataatcagctttcgtatgggagacggattcaggaagcttcaatttagcaagcagccgatcttcgcctttgtatacaagctggacacctttgtagcccggcccgtaatcagctccgatcattcctttgtaaaacgcttgagattcgattgttccctgtgtgcaccggcgcttcagctgctcaatatccgccgcttcctccggttccttccggatgatttcagcgatgccctgattataaagaggagcttcttcaccgatagaatcgttaccgccgtacattctgtattgaatctgtccgtcctcttcttcataaagtccgatatggacacggacagcgtcctgatcgactatcaccgggcggacccatacgatattctttaagcgcaggccgagagaatcctctgttgccccgccgatgcttttctccgccgcggcccgtgccatctcaagggtgacggcagccggcacgatcgccattcctttaatgatatgctcggcaataaaatactcttttcccgtaaattccgaactgaaccgctgctcctgcaagacggatgtattctgatgtaccagcggatgcaaaaacttcgcatctgtttgcttcacagtttcttccggccagaagcgctcctctgcgaacgggtaggtcggcgcactgattcttcgcggcgcggaatcctgatacaataagccccaatcaacacgcgctccttcaatccagagcgccgcaagtgctttcagcttttcatcacgtgtctgacatgccgcaagctcttccatctcctgagccgacacttctctgcttctcactttttcgccccgtaagatgttttggtcattgccgttgatgaaatcctgcagctgacgcttcagatcgtgacgatcatgactgataaaaacggctctctcttccatcgcttcacgtccggtctgatacgtaaatgccagatcatgcaaggaaacatcgttttcggcttcatccagaaagccggataaacaagttgcataggcagtaagacgctgcttatttctcgctgacagcggaacgatataaggcggctgtccgtcatttgatccgctgatcgttttgttttcatactgttcaaaaatggcgtgtgcgtttgttcctccgagtccgaatgagcttaacgctgcccggtgcggcgtctctctctccggaagcggttttctcttatccgccacataaaacggcgaaccgctgaatttgatattcggattcggtgacgtgtaattaatggtaggcgccagctcccgatgatataaactcatggcgactttgatgcacccggccagacccgctgctgtatccaaatgtccgatattcgtttttacggagccgattccgcaatactgctcccggtccgtgtaacgtttatacacttgctgcagcgcggacatttcaatcggatcacccaatgtcgttcctgtgccgtgcgcttcgatataggaaatcgtctccgggtgaatattcgtgctgtctaaaacatgctggatgacatcagtctgaccttttacactcggtgcgtaaaaaccgactttatccgctccgtcattgttcagaccgatgcctctgagcatggcgtatatgtgatctccgtcctgaacggcttgcgacgcctttttcagaagaatgacggcagctccttctccgcccgccataccgtcggctgaagcgtcaaatgccttgacatgcccgtcgcttgaaaaattcaatccgttttggtgcacatagccgatgcttgtcgctgcatgcagcgttgctccgccgacgagcgcgtattccgattctccgctcgtgatgcttttataggctgaataaagaccgactaatgatgatgagcaattggaatgaacgaaatagcttggcccttttaatccgagcttatgggaaaccatcgtcggaatcgtgccgctctgcgctaacacccatgagacatagccgtcaggagattcatggccgtctgtcgttttttccggtaaaagcgaccgatacgaattattgcttgccgacatatatacgcttgtcttcggaatctctttggatacatatcccgcgtcctcgacggctttccaagaatgtagcagcagaagccgaagctgaggatccataaattctgcgtctttcggagaaatgtgaaagaactcagggtcaaagagatcttttccttctatcgtcgataatgccggcacatagtcgggattttcgatcaaatcttcaggtacgccggcttcccgaagttcttcttccgagtagaaccggacgctttcctttccttctcttaactgcttccaaaactcatgatgatttttcgcgccggggaactggcaggaaatccccactatcgccacactgtcgtcaaagtaagacggcaccccgttttgcggcgtttgttctctttctctctcatcttgaccggatgcctctgattcagccgcctgtttagtttcaacaataaatcggctgatcgcctgaatggtagagtgttcgaataaatccgtgacggtaaaatcgcattccagctcctgtttaatgcgttctgccgccgcaacagccaaaagcgagtcgcctcccacatcgaaaaagccgtcttctgttttgatgcccgccgtattcagcaggtcttcccatattgcggtcactttcgcttccgcttctgttaacggcagtctgcccgtcttttcagaccgatgaacaattaccttgcgctgttttaggtctttgcggttcacttttccgctcggtgttaacggcagcgcatccagacggataaaatgggcaggcgccatataatccggcagactcgataaaagatggttgcggagcgctttttcatctgccgtatgaccggaacgggccgtataataagcaatcagctttttatgtccgttcttttcctgaacaacaaccgcctgatcaagaatgtccggatgttcgttcagtttcgtttcaatcgctcccaattcgatgcggaagccgcgaattttcacctgactgtcaatccggccggcatattctatatttccgtcaggcagccatctggccaaatcacctgtcttgtaaagcttttctccttcactaaacggattatcaataaatgatgccgccgtcagctcaggctgattgtaatagcctctggccagaccggcgccggccacgcaaagctcgccggccacaccgtcagggacggggctgagcttttcatcgacgatataaagccgcgtattgtgaatcggtttcccgatcggcgtattcctgcttgtgatttccttttggccgcagctgtagtaagcggcataaatagacgtttccgtcgggccgtatatgttttcaattctggcatgtttgaagatggaaacggcctttttgactaaatctttcggaaatgcctcaccggccaccatcacatatttcacagggccgtcttctgtaaatgccgtatgccgctttaccgtttccagaaatacattaaacacggcgggagcaaaattcagatgcgtgacctggtgggtttggatgtattccatgcaaagctgcgggtttttttctgcaccaggcggcaaaatgacaagccgtccgtttccgataaaccagccgaataattcagaaatcgaaacgtcaaatacgtaattcgtttttaacaaataggcatcctcttgcgcgaccggatactcagcttccaaaaactgcagcgtattcatgatggccctgtgctcaaccatgacgcctttcggttttcccgtgcttccggacgtatatagaatataagcgagatgatgcggttttgaacgcggcgtcagttttgccccgctgacagaacgtccgctcttttcaatttccaccgtgctcacaccgccgacggccaactgttcaatcatgccgcgcgtatttgcttgcgttaatacgattgaaacgccgctgtcagtcaacacgtgcgccatccgttcgtttggaaaagccgggtccagcggcacatacgcgcctcccgcttttaaaatggcgaggatgccgatgaccatctcaaaagaacgctccgtacaaatgccgaccgggcattccggtgtgacgcccttttcttgcaggtacacggcgagcgccgtgcttcgttcatctaattcgcgatatgtaagactgttttcaccgtatgtgacggcttctctgtcagggtggcgtccggctttttccgcaaacacttcatgaatgcagcgctcattcggctgatgagatcggcttgcttcacgtttttgattgagcaggccggaacaggcttcaaaagtgatctccggatcagaaagcaccttttctgccagtttcatataatgctccgccatccgttcgatgaaagaagggctgtagacatccgggttgtacagaaattgcaggacggttcccgtttcttttttatagacttcaagcgcaagctcaaattcgccttcctgatgaatgtcttctatcatttcaatgccgagtgattgatatagttccgccagcttttccgctccttctgtccggaagaagttttgatagaaaaacgcggtttgaaaaacaggcgaaaccgcaggcgagcgttccgtcttcaattctttgacaagcgcgggaaacggatacgcggcatggtccagcccttctgccagtgtcagctgcagctccttcaaaaacgccgtaaaggatttggcgcccgtcgccctgcttctgaccgcgatcatattaataaagtatccgatgacagactcaaattgagcctcagagcgccccatcgtcggcatgccgacgatgacatcttcctgattcgtatattgatagagcagtcctttgaaaatagcgagatacacaacggattcattgacattatgtttttgggcgcacactttaatctgccggttcagttcatcaggaagcaagcgctgatacgcctgccctttgcaagtttgaaccgatgatctcggataatccgacggaagctcaagcaccggcagcggtccttccagctgctttttccaataagagagatgcgtttttcccgcttcgctttccagcagctctttttcccatttcacaaagtcatgataatctgcggcctgctgaaccatgacaggttctttgccttcacttgcttttacataagcgtccagcagcgccgacataaacgtcataagagagacgccgtcaaaaatgatatggtgaatggtgattaacacaatcggctcccgcttcgcccgccggaatacatgaacacgcaggagcggcccggtttcaagcgcgaacggttcttttgctttttctttaataaacgaaagagcgtcacgcccgcttaattcagaaagatccatttcttcaatcggaaaatgccgatccgtatcttctatctgatacggaaggccgttttcctcttttatcacactggtcaaaatagggtgctggcgctgcacggacaaaagggcgtttttgaatgtctcgatatccagcttttgaaaacgaaagcataacggaatgttatatgcgctcatctccggaaacattttctgaagcatccacaaacctttctggccttcagaaagcggacgttttgcagttgtccgcttgaaagcctgaagcttttgttctacttcagcgatggtgagcgttcctgatctgtaggcatcgagaagttctttatgattcatagctcttactcccttctatgatgtcttgcactcttttaaaatctaatgtcccctcagagacctgtttcatcatggcgatgatctcctgatccgtatactccttgttatccggagcggcggcttctgtttcagtttcttccgttcggtaaaacgtttcgatcgtttctttgtgttctgtcaggtaatagctgatgacgtctccgagcgtggcatagctgtaaaataacgccggagtgacttcaatgccgtaatgactcgacaaaagagcggcaaatttggctaaatagatggaatcaaatccgaattccgcccagtttttatgcaggacgagtttatctttagatattttcagcagactgtgtatcagctctttcaaatccgcttcgagccgtttttccgtgctttcttccgggatgcggcggctcacggtttccaaaagcgcatccggttttgatgaatcgtcccgccgtatgcctaaaaatcgttcggcgcggcttcttttgccggcaatgacaaggcactgggtgttgtcttgagaaatgatgcgctcaaacagctcaatgccttcattagtttctaacaggcgctggccgcttgattgcaggtacatgcccgtcgtctcttcaccgccgacggccattccgccgtttttccagaccggccagtttatgacaaaagcgtttccgctttcggattgttcgtttttatagcgggcatacgccatttggaacctgttcgcgaccgcgtaatcacagcagccgaaatctcctaaaacagccgatgtggatgaaaagtagcagatgaaatcaggcgtttcgtttttcagccactcgtcaagaagcaggctcccgtttattttcggttcaagcgtactgcggaaattcccgatttcattttcaaagacggatgttctgctttcgatgcccgccgcatgaatgacgccgtgaatagctccgaatcgttctttcgcgcgcttgatgcagtcgcccattccgatcggatcacaaacatcggcttcggcgtaaagaacacccgcgccgagattttccaggtctttcattttttctttcttttcttcattgatcggcgaccgccccgtgagaatgacatttgcctggtagttccgggcgagatggcgggcaaataagtagccgagccctcctaatccgcctgtaatgagatatgttccgccggttctgatcctgccgttttctttcgttagtccggttggttcggtgtgatagacatatcgttttccctcttccaagaaaacggtatggtctgtttcagctttcagctcatcccaaatggttctcatccagtccgttatggccgcgccggcttttctgaagtggccggtaacacttgttttcggaagaacaatgccgagcgaacgctcaaagccgatccatgattccaagtagcacctttccagaccggatgcatattcccccgccaataacagcctttccggctgcagaccggtctcagccattgctttgagaatatggacaatacatgaataatcttcgatgcagcttttatcttcaagcgcccataaatacaaaatggcagaagcttcaccgtactctttttgaatacccgcaaaagcgttcacatatgattgcggatcttcccgcaccacttggcagcggccggcggacaaggtctcataccggtctccctgagcgataaaaataacgtcaatgtcactgtcatacgatttgatcacagagacggcttcctgctgcttcttctgatcagttaagaaagaaatcaccgttttgacttgcttttctccggcagccggcagagcctgttctttaagaacttctctaaaagccattacttcaaactgctccgccggatcactttcatcagccggcgcgttaacgggcgcggccttgctttgtacaggctgctgatgccagaagcgttctttcgcaaacggataagcaggcaggctgatgcggaccggaggacggtctccgtataatttcgcccaattgatgtccaatccttttacccaaagctcaagcagcttagaatatttccgtttgctgatccaagcgtctatgatggtttccatgtcatcatcggccgcaaatacggcaagcatccgtttgttttcttccgtgccgtcacggtgcagtccggcgttgttttgtccggcgataaatccgttcagtttttcctcaagttcatgaagtgaatggacgataaagccgagacgctcttccatcggcacccggccagtctggagagtaaaggctatgctcataagatcgcggccgctgtatcttttttcacggatggcgtctctgagctgttttgctttttcagtgagccgttcgctgtttttcgcggacaggacgatgatggcgggctgatctgccggcgtctcatcaggctctttgtctgccgtatattcttctatgatgaggtgggcgtttgctcctcccgcgccgaagctgcttaaccccgcccttctcggaagctctttgccgccgatgacgggacgtttccactcaccgagctcctgctgaacggcaaacggcgtatacgcgaaatcaatatttgggttcagctgttccgcgtgcagggacggcgcaatttggcggtctttgagctggaataatatttttgtcagacccgcaatgcccgctgcgctttcgcaatggccgatatttgattttgctgagccgatggcgcaaaactgtttgtctgttgtatcctcttcaaatgctttcgttaatccggcgatttcaatcggatcccctaatgcggtccccgtgccgtgggcttcaatataactgacggtgcgcgccgggacgtttgccctttcgaaagcttcttttattaaggcggcctgcgcattcggattcggaacggtgtatccgttcgttttgcctccgctgttaatggcgcttcctttaatcacaccgtaaatgtgatcgttgtcggcaatcgcttgctccaacggctttaatacgacagcgcccaccccttctccgtctacaaaaccgtccgcgcggtctccgaacgatttgcacgtgtcgcttgcggaaagcatgttcatgactgacagattcatataatgaatcgggtcggtcactatgtttacgcccccggcaatcgcgcattcgcttgaaccgctgtatatgctctcaagcgccagatgaatggctgtcaaagaagaggagcaggctgtatcaacggcaatgctcggcccttggaaatcaaaaaggtaagataccctgttggcaatggaccagtagccgtagcctgtcgggtagtttttgttcatcgcgccggcaaaaacaccgatttttctgctttggcacaggttgtcaggcgtatagccggcatcctcgatactcgcatacgccgtttctaaaaataatcgctcctgcgggtccattcgctccgcttccaaaggagaaatctgaaagaacagcggatcaaacttgtccatatcctcaatgaagccgccccatttcgtataaatagagccttctttacctttctcttcatcatagtaatcctgccagttccagcgttcctgcggaatttcttctatgcagttttttccttttttaatattggcccaaagctcagccgctgtttttgcctgcgggtagcgtcctgaaacaccgatgatggccacgtcgcgaaccgaactttgccggacggtctctctggctgcccgcttttccctccgccgccagtcagtgcgaagcggcttggccgtctgtacagcctgcggttctggtgatgccttccgttcttcctgaacaggcgtttgtcccgtcagtttgatcatcgcgtcttttttcgttttgattaagtgagcgacgagcgcctcgatcgtctgatattcaaaaaataaagtgctgctgacttggtccaatacatttcgtaacgcgtttgtcagctgtacgacgacgatagaatcaattccgtatttttcaagcggcgctttcggatcaatttgagccggcggaatttttaacgtttctccgattaacgttttcaagtactcggtgcttttttctgttaaagacgtgtcgcctttttgcaccgttgtttgcggcgctttaaattccggcgcttgtgctgcttttggcggagcggtccgttttccggcccctgctttaagcgttttttggcggacaacgccgttgctttttgccgctataatctgatggcttaattcatgtgccgcttctgccgggaaaaagacagaatgccagccttcactttctaacacgcgcttccagctttccggatacaagcccgggcaccccggaatacgaagggcagaatcttcatgcagccaccagccttcaagcagtccgaaagtaatatgcgggaacaggctgtttcccgccatttcatttaagagcagcaaaccgttgtcttttaaaacggctttagcgtttctcagcgtctggcggatgtctttcgtcgcgtggagcacattggcggcaacgacgatgtcgtatgcgcccggctctatgtcctggccggcaagcggcgcttctgcgttaaaaagcttatacgtcagataaggattccgtttgccgtattccgtctccgcatgcacgagaaaagctttcgatacatcggtgtaacagtattcttttatatggttttgatacggcctaagcttttcaaatatgcctgcgcttgtgccgcctgtgcccgctccgatttccagtatgcggatctcggcttttgaatgtttgctgatgttttctttcacataagccgttaatgtatctgacagggcgctgttaaagtaatccgcgacttgattgtgcttataaattccttcaacaagttccattgaagagtgcgggaacatgatgtcagtcgccggcacatcttcgcgcagaatgtccggcagtgctttaagcatcgtctcggctaaaacagtcatcgcttttgtatcggcgttattgagccattcctctttttcctgctcccatttttgccatagcgaggcggttgtgtcttcggcacgggccgacagtttatatgaatccgcattcccttccagataaccatgttccagaaggaaagcgatcgtttgattgagccattttttaaaatattcgtgttcgggctcatacgctttaaggctttgcggcgtcagcaagtctgcttctttaagctgggcgatcaaaagctgatacagaaaatcatcgagcttttgatgttcagcctcttttacaagacgtgcgccgggcggagcggccttcagctgttgtgaagagacaagcggctgagacggataaacggaaattttttctgtttcactcatcccttcgactgcgaccggttttgtcgtatgaatgaaagccgcttgatcaaccggcagcgtcataagggtttcaagcgcctccattgcagcgtccggttcgatcaatcccaatccgatctgatccatcagctgaataaaattgccgtcttcagccgcttcgctgttgccccaatagccccaattcatgactttgaccggacaattccacgtctgatcaagttctttcgcaaatgcgtcactgaaagcgcatcctgcggcatagtggctttgtttcacgttatggataaatgccacaagcgaggagaagaagagcgcaaagtcaagcggctcccgtccaaatacctccgccatggacacactgacatcggcttttgcccgcagcaccgatttgaactcttctgtcttcatattatttaagctttgctcagacagatccattgccgagtggatgattccgttcatttttgtgtgacgctcttttatgaactgataagcccgctctaaggaagcactgtcagcggcatcggcggaaacatattcaggcgccgggccgaatgcgctgagccggtcgagtttcgcctgtatggaatcattcagtgtgcttcttccgatccaaatgatatgtgctttgtagcggcggatcatgtattcactccatgcctcgccaagatatccggcgcctccgatcacggcataaaccccgcctgtttggtacagcgtgccgtttttcggcatattgtcaagcggtatcagctgacgctcaaacagctgctgattgcggtacgcccaaatttgaccgttttttccggcagacagactgagcgcctctttgaccggccagctgccgtccgtttccgtgtcaatcatgcggatattccaatgcggatattctttcgccattgttccggcaagtccgctgactgcggcctgtgacgggtcggcgctgtcttgatcggaaaacggctgggcatttgctgtgacgatgcaccagtccaaatgtttttctccgtaccccaaggcaaataatgctttcatcagcttgaacacatgaagaacgtttctttcctgttccttgaggctgcaagcactctcagcctgcggagcaagccaaatgatttgctccagttctttttgtccttcaagcatgtgcgtaagagatgtgatatcatccgtacctctgatcggataataggaagcgttcggcagatgttcttttatgcacgtatgcgttctgtcagtttcaccgaaaaccgcagtctgcttttccgctgtttttgctttcttcgttttttcaagtgcaacgggctcccatgccggaatcagcatcgtatggccgacaggcgcttccggggtttctccgcccgctgtttggcctgtgtcaagcgcccggacggacgcgcctttcatccggacataaaccgtaccggcatcatcgcacatatcaatgtcaaattttcttacgttgtcatctgctttgctgccttctgtgtaccggatatatgaccagatatgttcaggacacggcccgaacacttccacttcctgcatcgcaaacggcagagaaagctcgtggctgtctgcatcgtcatgtattgagcggacaagcagaccgactgaggcgtgaaaagcggcgtccatcatactcgggtgaagcgtatactgttctttattgtcatgtacggcagccgggagtgaaatacgggccaataatcggtcttctccgatcagcaattgctgtacgcctctgtatgcctctccgtaatccagaccgatcttctcaaaagcaccgtaacattcttccgcagtcacggtccctgaattgcaggaagctttgacagactcgatatcaatctgggcgcttcccggttcggtaatgaccgcttcaccctggctgtgaataaccggatcttcgccgttttctgcctcactgtatatttcataggtaatctcaccattatcttctgggtaaagggcaatatgtatttccttcggtttgtcttcaatcatgaccggccggacccaaacaacctgcctgagtgtgacgctatggcctttttccgtcacggcagcagcctttttgaccgcctctctggccatttccaaataggcgacacccggcaatattttttgcccgttgacgacatggtcagataggaaaaattcatctccagtaaaaagagacgtgaagcgctgctgcgaaaaatctgacgtgttttcttgtaaaagcggatgcagcactgtgcctgacgggcttttctcctgttttttctgctgcggaatccaatagcgttcttttgcaaacggatacgtcggaacgcttgttttacgcggtttacccgaagcgtacagcctattccaatctattattttcccttctgcccataactcggcaagccgtatcggatcatccgtctcgggagcggtttcgctcagttccggcagctcggcttgtccgcgccaaagaccggggatgttttcgtttccttttacgaaatcattcagcttttctttcaagtcgcgggtgtcatttacaagaaagacagctctctcctccattgcttcacgtcctgtctgaagtgtataagccagttcagacagcaccgtcttttctgaaagcgatcgggctagtttttccgcataggccagaagcctgtctttatttcttgctgacagcgggatgagttttgctgcattgttctcaggtgcaggcgctttttgttcaggctgaatgtattcttctaaaatgatatgggcgttcgagcctgatgcaccgaaggaactgagtccggcccggcgcggataatgtgtgacttttccgttttcttcggctgccggctgcttccacggagcagtctgctgctgtacgtaaaaaggagatccctcaaatttcaggtaaggatttaattccgcagaatgcagtgatttgacaagcgttttgtgatgaagctgcagcgccgcttttgttaacccgctgatccccgccgctgattctgcgtgaccgatatttgatttgaccgaaccgatggaacaaaattgctgatcctgcgtcccttggctgaacgcttttgacagaccttcaatttcaatcgggtctcctaacgaagtacccgtgccatgggcttccacataactgacggtccgcgggctgatacctgcttttttcagacaggccttaatgacttctgcctgtgcagcaggactcgggacggtaattccgcttactttcccgacgtggttaacggcgcttcctttaatgacagcgtaaatgcggtcgccgtcttgttcggctttttccagcggcttgagcaagaccgcaccgactccttctccggaaacgtagccgtccccgccctcgccgaatgtgcggcagcggccgtcacttgagtgcatccctacgcttccgtagctgagatatttcgccgggtgcagcgacaagttcacccctcccgcaagcgcggcttcacattcgccgcggcggatgctttcaatggccagatgaacggcggtcaatgatgaggaacaaacggtatccaccgcgatgctcggcccgtggaagtcacaataataggacactctgttggcgatctgcgcataattcagtgaaactggaaaaggatcagcttcagataattgttctgcgccgattaaggaataatctttatgcatcacccctgcaaatacgccgatcggatgctgtttctcccctttattccccagcgtttcaggcgtataccccgcatcttcaatcgtttcccagcatgtttctaaaaacaggcgctcctgcggatccatcgtttccgcctcacgcggtgagattctgaaaaactgcggatcgaaacagtcggcatcgtcaatgaaaccgccccattttgatactgtttttccagacggggacgttacgttttgatatgttttccaatcccatcgggacttcggaacttcagtgatgcaatccgtgcctgccttaaggttttcccaaaactccgccacacttttcgctttcggatagcggccggccattccgataatcgcgatgtctccggtgtttttatgatgttctggcgcgtccggcgcttcagcttcagaccgtgatgattcggctgcacgttcctccgcatattcaaatgaaccagtctttttcagaaaggctgcgagttcttttatatttgtatattcaaagagaagagtgggcgcgaggtccgcacccgtctttttactgatatcctgtacaatctcaagcaaagaagatgaatccagtccaagctcgtagtagcctgcaagaacgtccagcgtctcccaaggctgcccaagcttatcagccaaaagcttctttaaaaacagaatgatgtctttttcatctgcgctttccggctcggctgcagcctgttgattctgttcggctgtattcgcgtcttcttcgagccgaaccgcttttcccgtaatgtttttaagctccgccaccttttgtccggatcggctgaagtactcgatcgtcatcgttgtgagttctttttcctgacggacgccggaagcggcgatacgcgccgtgcactctgattgaagcctgtcagcggccgtgaacgattcataatataaaggcaggtgaagccggtttgtttctgaaagcaaaccgctccccccgattccgctcgcatccaaaagggccggatggaataaaaagaaatcttttccttcttcgcaagaaagctcagccagcatgccgctttctgtttcgtacaatcgtccatttgatttcatcatcccggaatgaaccaagtcatgatccagacagcggctatacatgtcatcaagattccgagacctggctgactgcttcacatcgccgaaatcaatgatttcgtcaaatgtcacagcgtctcttttcaccatttcagccgtcgcatattgtatattgtctgacagctcgtcaccttgctgtttctgccctgaaagggagatgatccactttccatctccgctaacagaacattgaatggtcagaatgattgcagccgtttcactgacggttaaaggctgataaatcgtaacgtgcttcaattcaagctcattgtatacataaccgtgttcctgaaaaacctgataaatcaaatcgatataagcaagaccgggcagtaccgcttcaccaaagaccatatggcccttcatgatgggatgatccagtgagatattgattttttccgatatcattccttcccactcctctcttatttaaatgctttccaaaacatttttttcgcaggaagctcttttttctccgctcgtacgtcaggttcttttaccagagccttacgtcttaatgacggtaccggcagcggctttcttttcattcgggtatctttttcttcccaagcttccagaatgacgtgggcgttcgttccgccgtcggcaaagcagttgatggctgctgacggtctggctgcatcccattcgccggctgttttatgaaagtgaaaatctgtctttgttatatcaaaatgcggcatcggttcgtctcctgagagaaacggaaccgtttgtttatgcttcagcattaatacgactttaatgaagcttgcgatgccttctgcgcaaagcggatgcccgatgttcggcttgattgacccgatgccgagcggaacatgctgacctgagcggtatacggaatgaatcgccttcagctcaagcaaatcagtcaccgcggaacccgatccgtttgcttcgatataactgatgtcttccggctttttgccgcttttgagaagcgcgctttgcataacgtctttttgcgcctgcatattcggggctgacgggcctgccgttctgccgtcattgttcatggcggcagccttaatgaccgcgtgtatcgtatcgccgtctttttgcgcctggcttactgtttttaacagcaccatgccgacgccttcaccgaggaccactccgcctgaacgcttgtcaaatacgtgaaatgccggtttctcgtttaacagcccgcgctcttggaacatccggtgcgccgcatccgtgttcagcaggctgacgccgccaactaccgccgctttgatatcgccgcttctcagtgcctgaacggccatgttcattcctgtcaaagctgatgaacaagccgtatcaagcacgatactcggcccgcgcagatcaaaaaattgcgaaacgtttgccgctaaataattctgcccgcccgcaacaatcgggttgcgggtattcgcaagactttcaggatcaggctgatgctggctgcggcctccgatatacacaccggcttctatgcccttgatttcttcacgggtatagccggcatggcaccaaagtttcaagctctcttccagcaccgccaacgcctgagggtccatcgctttcgcgtcgttttccggaatgaaaaagaattcggaatcaaagtgatccatattgtcaatcaatcccgcaacgtattgatttgcatatccgaaacgttccgccgggacggagccgattgcggacctgccgcttctcagcaagtcccaatattgttctaacgattccgctcccggaaaacggcagctcattccgacgacggcaatgtcttcagttacagcagcacgcttttgctcagtgtgaaccgtttgtacggcagccggaaccaacatttccgtatcaggttcctccctttctgcaagcagcggctgtccattggatacaagccattcggcaaacgcgtcaatcgtcggatgttcatataaaacagacggatctaagtcctctttgagcgcttgattcatttgctgtaaaagctgcgctaaaatgatcgaatcaaccccgtaatcctgaaacggttcgtctgtttccagttcatccggagcgattttcagctcatcggaaaacagtttcacaagccacgccttcgtatcaagaagcagttctctgtctgaatgtttttccgcgtctttgccgtttattacggcttcagtctctttttgttttttctcttgacagagcagcctgtcgggatgccattcgctccgatcaacgatagccggcagaacggacgggcggatgttttcagataaaatgcggtccagcaagtcaagtccttccgcattggacagtcccagcagcccggtctgcttcaggttttctgtgcggacttcacccaatccggtttccttccagttcggccattgaatgctgactaacggatattgatgctgatgagccgccgcgaaataatccatgtacgcatttgccatcgcataatccgactgtcccgccgcgagcgccggaacgactgcagatactgaagaaaataagacaaaaaattgcaaaggatcatttgtgaaaaggctgcttaatgtttgaagcccggcgactttcggttcaagcacttcttgtatgtcgtcggcagtctttctgataaacgccggatttactgaattaaccgatcccgcacagtgaatgacgccgccgatcggtcccatcgtgcgccggatcgtttcaatttccgctgccgccgcatcatgatcagacaaattcagactgatcaccgccacttgcactccttttgcttcaagctcttcaatcgcccgtatcttctctctcagcctcgtattaacggctgtccgtttatgacggggaggaatcggctccctgcctgtcagcactacttttttcacgccgtgtttttctgtgaaatggcgggcgcataagagacccagtcccctcgtccctccggtaatgaaaagcacatggtcttcaggaaacggtgctggcttatgttctgctcgcttcccgcttggaatctcgctgaacaaagcacggtatctttgtccgtttcggcggcagacttccggttctgtgctgtccgccgaaaattcatctgcaatctgtttggcaagcgtctgctgatccgtatctgtatcggcatccatgtgtctggacgtcacgttttgatactcattttgaagcattctgtacaggccgctttttgccgctcctgcaagatgaatcgttttctgctgaaatggctccaagccttttgttacatatagcagcgtcagcggccgcgcttgccggcggcttgtatcaatcagagtctggagccggctgatcccttccagtgaagggtcttcgtctccgcatcccgtcagatcgattacgccatctatgtgattccaatcgctagctgcagtgtcagcggaatcggccgggagaatgaacgagtcagcgaaatgcttcgcagtctcttcggcaagttccgctgttcttgcatcagccagaatcatgaccgtcctgccgcttttctcaccggccgaatcgatctcacacggaacccattgcttttctaaaagcacagccttgcaccggtcttctgtttcctgcgatacggctttcggctcaggcagccagtacggctccttcgcaaatgggtaagccggcagactgattctgcggggtttttcgccttgatagagtctgtcccagtccgtctgaagccctttggcccacaattccgctattttggcgtattttttcttatcgaaccacgacctgacaagctgcttcagatcatcgtccgtttcaaatgctttgatttctttttttgccgttttgatgtgggcttcatatatcccttcacccgtatttccgtttacaaaatcggttaaacggctgatcagttcttctctcgaaccggctgtaaccgcaagacggtaatccatcgcatcacgcccggtctgaagcgtgtatgccatatccgaaagattgatattctgattggcttttgcaaattcgatcacagactcagcataggtttttacctgcggcgcttttttcgccgacagcacaaaaatgtttgtctcatcagacttgcggcttccccggtctttcggctgatactcttcgataacgagatgagcgtttgtgccgctgtagccgaatgagctgacgcaggcccgccgcggtgctccgcctgtttcccaaggtttaagttcggtattgacaaataaaggcgagtcatcgaaatcaaaatgttcattcggcgtgctgaaatgaagggtcggcacaagctgctggtgcttcatcgacagcagaaccttctgtacgcttgctacacctgccgccgccgacgtatgcccgatattcgatttaaccgaaccgatggcgcaaaattgtttgcggtccgttttttccttgaatacagaagataaggcttctaattcaatcggatccccctgctttgtgccggtgccgtgcatttccgcataggtgatgctctcagggtggatgttgtgcgcttcatacacttgacgctctaaatccatttggcttttcgcgcttggtgcggtaatgccgttggtttttccgtcttggttaattccagatccgataatgactccgtaaatatggtcttgatcggcttccgcatctttcagcctcttcaaaacgagcgcccccgcgccttcgccaggcacaaatccgttcgcactgttatcaaatgctttacattggccgtcaggagacagcattccggcttcacacatgctgatgtatgattcaggcgttaaatacaaggtgacaccgccgacaagggccatgtcaatttcatgattcaacagcgcctgacgcgccaaatgagtcccgacgagagatgaagagcatgccgtatcgatcggaatggccggccctttcaaattgagataataaggcaggcgggccgccgcgatgctgaaactgttgcccgtcgcgcttcctcctgtctgatgtttgtttaacatcatgccgtattcattgttcataatccccaaataaacgccgcaattttttccgtttaattcttttgagctgtaacccgcatcttcaaaggctttaaaaccttcctgtaaaaatatccggtgctgcgggtccataagttccgcttcagacggagaaatattaaagaacagcggatcaaactcttcaatgccgtcaagcataccgattgatctgcagtatactttgcccttcttgtttaaggccggatcatagtatttgtttacatcccagcgggaaagcgggatgtcgcgaatggcgtttttcgcacgggctaagttgtcccaatatgtctttaggtccggcgcatccgggtacttgcccgacatgccgacgatggctatcgcgtccgctatctcgtctttaggctcccgtttggcctgcaccggttcaggttccttttgaaccgttaatctctccggctcggcaggtgttttctcctgcggggcggcttgctgtgtaagcggctttggacgtacgggaaccgcctgttttttcctgccgcggacggacggctgcgtacgcagaaaatcggcaaattgacggattgtcggataatcatacactttcgttacgttacagtccgtgccgtaccgtttattgacggcctttatccattcaagaccggtaatcgaatccataccgaggtcaataaaggcctcatcaatatccacttcatgccgctccatgtacaatacatcagccagtgcttttgataactcgtcatgcaccgcttcaatcggttcttccggttcggcggaagctgccgtttcagacatcgcctccagaatatctgcttctgcttgtatcacatgctgcttatgagcgtttaaaggctgcagcagtatgtttgacggtttttttacggcctctgttttctgcggttcggctgcttcctcaaggatcggttctgtcccgagttctttttgcaagaaggccgcaaactggcggattgtcggataatcatatactttcgtcaccgtaagggacgtgccgtacgctttattaacggcctttatccattcaagacctgtgattgaatccatgccgatatcaataaatgtgtcatctgcgtcgatatcgtcggcatccatatataaaacgtccgccaacctttccgttaattcggcacttactttttcagcggataccgccggacgggaagcagattgtacggttcttttcggtttcgcgccgctcaaaggctgcaatgaaatgtttgacggtttttctttggcagtctcctcgtgaagagttgctacttcaatgaccggttccgggacggccgccggtgcgatcggcgcagactgtgtttcggccggtcttttgacagctgcatcagctgatgtgtcgatccaataacggtcttttgcaaacgggtaggccgggagactgattttttgcggtctgcccatttgatacagcttatcccaattcagcggaaggcccttcacccaaagctctaatacctttgcggctttgcctttttcaagccatgcctcaatggttttttccatgtcctcatcagccgcaaacagcgccatcgtgtctttattctgtttgacttgtccgcggtagagccggtcaattgactccttgccgcccgtaaattcgtcaagtttttcttcaagctcgcgcaaattgctgacaatcattccgagacgctcttccatcggttcacgtccgatttgaagcgtatatgcgatccggctcagatccgcttcccggtaacgcccgctccgcagcgcatcaagaagacgttccgcccgtttttgaagcctttgttcatttttcgcggaaaggacgatcatcgacggatgaggtgcggcaaaagccgtctccttatcctcatcagcggtatattcttcgatgacgatatgagcgttgacgccgccggctccgaatgaggaaagccccgcggttctcggcagttctttatttattccgttttcatttatgaccggtcttttccactcttcaagcgtctgctgcactttgaacggcgtagcgagaaaatcaatattcgggttaagcgtccgggaatgcagtgacggtgcgagtttcttatgtttcatttgcaggagcaccttcgtcagacccgcgatgcccgccgcgctttcacagtgaccgatattggattttgctgagccgatggcacaaaactgtttatcttgtgtttgttctgaaaaggcttttgtcagacccgtgatttcaatcggatcaccgagtgaagtcccggtgccgtgggcttcgatgtagctgaccgccctcggatcggttcccgcgtcttttaacgcctgtttgatcaccgcggcttgggcgttcggattcggtacggaatacccgtttgtttttccatcatggtttacggccgttcctttgatcaggccgtaaatatgatcaccgtccgctttcgctttagaaagcggcttaaggagtaccgctcccactccttcaccgggcacataaccgtccccgccttcaccgaaactttcacatctgcctttgcttgataaaaatctgttctggccgagcatcaaatatttattcggatgaacggatacattgacgcccccggcaaatgctgtctcgcattccccgttccgcaagctttggcatgccagatgaatggctgttaaagaagaagagcacatcgtatccagcgccatgctcggaccgttaaaaccgaatacataggaagccctgttcgcaatagatgacggatttccggtcagcgcaagcgattttccgcgcgcctgttcttcggctccgtaaagctgatattcctcatacatgacgcctacgtaaacaccgacattggcgccaagcaaatcacccgatttttccgtgagctttttgcgcgtgtaaccggcatcttccatcgtttcgtagacacattgcaggaataaccgctcctgcgggtccatcaattttgcatcccgaggcgaaatagagaagaattgcggatcaaatttgtccacgtctttcaaaaatcctccccattttccgtacgtcttgccttctttatctttatcagcgtcgtaataaagactgtgatcccagcgatcgtttggaatttcagttatgcagtcagtgccttcactcaagttcttccaaaattcctgaagattttcggcttgcggatatcgtcctgatataccgataatcgcgatatcttcacgctccgtcactggatttttccgcgtgtctgtgcggacttgcgcaaagccttttttgccttcattccgtttggaaacgggctttatttcggctttctcagacagcgccggtttggctgcagaggtttcttctgttttcagcccggtcacttccagcagcgtgtcccggtgtgctttcataaaatactgcgccagcgattcgatattctgatattcgaaaaacaatgtttttgacaatgaaccgaagctcttttccagccggcccgtcaaatgcataatcataatcgaatcaattccgtaatcttccataggcgccttggcgtcaattttgccgacaggaagtttggttacttccgaaagcacatgtttcaagaaatgctccgttttttctgcaagcatgttctctccgtctgccgtaagacctgccggttcttccgtttcgctgcccttatccgactggtcatccgctgattttttcagaaacgcccggatttttgcggcgtagccttccgtcaccatgatttgggatgtgtttgccgcccacccgcggtacaaagcatggatgccgttttctgttttcatagggaccatgccgctttcttttgtcagcatcgcttccgtttcagcatcaaccgtcatgccgccgtctttccaaagcggccagcagattgaaagggtgtgtccatagcgttcatttcgggcttttttacggtttcttttttcactgaaggcgttcatgaacgcattggccatcgcataatcagcctggcccgcgcttccggcgcttccggctccggaagagaaaagaatcagaaaatcaagctcaatgtcctttgccgcttcatcaagatgaaccagtccggagactttcggcgccagcacatcacggatttcacctttgtgctttttcagaatataattgtcttttatcgttcccgcgctgtgtatgataccgtttaatccgccgtactgccggcagatgtccgctgtgagcgattgaacttcttgtttttccgtcatgtccgtttgtttgtacacggcttccgcgccgagatcggacagttcttgcagctggtcttttttacggttatccaacagagaacgccccgttaaaataagcacggcgtcttttgcatgccgggcgatttctttggcgaataaaaatccgagtccgcccgcaccgcctgtgatcagataaacacctttatccttccacggcttttcggcgccgaactgttcaagccctgtttcctgccattgtgccgtatagcgcttgccgttttcatagcgaatatgtttgtcatcaggatgagcgctgcattcttttacatatcgggacagcgtgtctgccttgacgtccggctccaattcaatcagctggccggtcaggttcgggttttcaagcgccgctgttttcaaaagccccgttaagccgcaaaggagctgcgtatccgcttcttgaggcacgacaatctgaatgagctcgcgcccgccggaatttgaagcgagaattttcttcacttcttcgaacgcctgaagcgcacaagcttcaaaccgttcgtcttcactcttatgctgatcacggagcacgtgacagctgaagtctgtctgtatgctgttcatttgatccgtaaaccggtctgatatcatcacgtgacgggctttgaaatgagtcggcgctttttcatgtacagcggccttctcttcccatacgtgttcaaaaaatagtgtatctgttttatccgtttcaatttcccgtgcggaataaccagtcattttcacacatacattgccttgttcgtcacatacatcaatatccagcttctgcacggcatcttctggcttgctttcgccgctgtacgcaatggaaacccacatatcgcttttacagcttttcaacacatcaatctgttcgagagcaaacggcagcatcggccttatgtcagtcccgtctctgtcaagcattaacccgattgtcgcgtggaaagccgcatccaaaaggctcggatggaggacaaactgatcttttgtatgagaaatagatgacgggagtgagagcttcgcgagcactttgctgtcttttgcatagatttccgtgaccgctttgtgagcatccccgtattcaatccccatctgtttgtatgcctgatagcaagcgtcaggtgtgatcagacggcgtgactctcttaatttgtcaatctcgattttggccggttcgccccctcggacaaacgccgcgcttccttgcgcatagagaacgggctcttgttccgaggaagccgattcaccgtaaaccgtgaagcccatctccccattttcttcatcataaagacggagatacagttctgcggattcatccgccgctgtaaacggacgtatccatacgacgtttttcagacggactgttccttcttccttcgtttctgccgcgtgttcaacggccgcccggaccatttccagataagccgcgcccggtaacgtccgctcgtttttgacgacgtgatctttcaggaaaaattctccgccgctaaaagaggaccggaaacgaacacctgacatgtttgatacattttcatgaaggagcggatgcagcatgcctgcccttttttgcggcagcgattctcttttctccgccttcggcacccaataccggattttttcaaacggatatgtcggcaggctgatccgattcggtttgttttcaccgtacaagagattccaatccatcgttcctccgccggtccacttttcggcaatcatctccagactcccggaagaaagccatttatgtatcaagtccggagcaagctctgcctgattgcttttatcggctcggttccgccagcatccgctgaccgttttacccgccagaaagccttccagccgctctttgagctgtgtcatattctgagcggtgaacgcaacccgctcctccatctgttcacggccgatctgaagtgtatacgccgcatcctcaagcggcaggccgggataaataaatgaagacagcttcgcaacatactcttttagccgttcttcattccgggcggaaaccgggaaaatgaaagtctgttcttctgccggttcatacgctgttctctgtgattcttcagggataaattcctccagaatgagatgcacgtttgaacctgtcgccccgaaagaactgatgcccgcacgccggggatatacggtctcgtttccgttttccgtcactgatggctgctgccatgcttcggtatgatgctggacgtaaaacggtgattgttcaaaatctaaatacggattcagctcctcggaatgaagagacggcaccaaggttttatggtgaagctgcagggcaaccttgcttaagccgctgatgcccgccgccgattccgcatggccgatattggacttcactgatccgatcgaacagaactgtttgtcctgtgtgtactggcggaacgccttgacaaggccttgaacctcaatcggatcgccgagagaagttcccgtcccgtgcgcctcaatataactgaccgtgcgcggatcgatgcccgctttgtccaggcattcttcaatcaaatcggcctgcgcgacaggactcggcacggaaattccgctcactgtccccacgtggttgacggcactgccctttatcaccgcataaatccggtctccgtcttttaccgcctctcgcagcggttttaataaaacggcaccgattccttcagccggtacatagccgtctccgtctttcccgaatgtatgacaaaccccgtctgttgaaaacatgtcccataaaccgtatgtcagatatttattcggatgcagcgacaagttgacccctccggcaaccgccgattcacattccccgcgccgaatgctttccgcagcaaggtgaaccgcagtcagcgaggatgaacagaccgtatcgaccgccatgctcggcccgtgaaaattgcaaaaatatgaaactctgtttgcgatttgcgcataattaagagaaagcgggaatacatgatcttcagaagaagcttccgccccgaccaacgtataatccttatgcatcacccctgcgaagacaccgacgcgctgcctcttattccgtccgcgcgcctctgcgagcgacttcggcgtatatccggcatcctcaatcgtttcccagcatgtttgtaaaaacagccgttcctgagggtccattgtttcagcttcccgcggcgtaatccggaaaaattggggatcaaagcaatccggatcatcaataaatccgccccattttgaaatgctctttccggaaggcgactttacattttcaaaccggcgccagtcccagcgagactccggaatttcggtgacacagttttttccttctttcaggttttcccagaattcatgaatattttcggcctgcggatagcggccggccatgccgataatcgcgatatcttcatcttgcggaacactgcttttccgtcttctttctgtttgcttctcaacctgcttctctatttttgcaggagacgcgctgaaatggcttccgtactgctttgtcaggaaagccgccagctctgatgccgtcgtatattcaaacagcaaagtcggagaaagggtttcgccgattttttcgctgatcgtttcgacgacgtcaagcagtccggacgatgtcagccccatttcatagtagccgacttgagaatcaatctgttcaagcggcttgccgattttttcagccatcagattcatgacataccgttctgcttcctcatgcgggtgtccgccttcaagcgatgccgcaacttccggtaaaccggctttttcaggaggcttctcagcagtctttcggtctgtattgatcagctcggcatcccgcacgagcttgcttgtgaaatctttcagctcggctacttttcggccggatgtgttaaaaaactccagtgtaatgtaaatgagctctttttcctgccgaagcgacgaacgtttgattctcgtgatgcagccggcctgcaaaggttcggaagctgtaaaagattcgtagaaaagaggcagaaacagcctcttttccccatttaacagcgaggagatcaataggtttgcgccgacgccgcttccgtcaagaagagtcggatggaacaaaaacccttcggcctgtcccatcgcgtcttttccgagcgatacatcaaaggtgacgccgtcccgctcctcaaacacttctccttccgctttcatatatccgctgtgaaccaattcctggcttctgcattgggcatacagctcatttaaatcgatggtgcgttccgcctcgcgtttgacagagtcaagatcaagcgtgtcactgaaaactgcgggtgccgtctcgtgcatttccgctttgacgtaaatacgttcttccggctggactcgtccgccgctgacctcagccccttttgcggtaagtttccagcgcccttcttttacctttgtacattcaaccgtaagcttgacggcgctgtcttctttcgcgataagcggctgatatatggataaatggcgcagctgaagcccgtcgtatgaatagccgcgctctttaaaaatctgataaaacatatcaatataagccaatcccggaaggactttttgtccgtaaacgtcatgatgtaaaataaacggatttttcagcgataaagtgatttgcttattgaagttcttcacgttaaacctccacttcataggtatcccagatgtttgccgcagctttttcgttcgtttcttctttgctgtccggcgaaatcagccgcttatttaatgcaggcggtgttaaagggtggcgcttgattcggcgcccttcgtctccctgccacgcttccacaatgacgtgggcatttgttccgccgtcggcaaagcagttaattcctgccgccggcattggtgacggccagtctgccagagtgcggctgaactgaatattggccttttctctatcaaaatgtgtgttttcatgctcacctgataaaaacgggataaagctcttttctttcagcatgagaacaacctttatgaaacttgcaattccttccgcgcaaagcgggtgcccgatgttcggtttcacagatccgattccgagcgggccggcgtcttttgaacggtagacggattgaatggccttcagttctaacagatccgtcacgaccgtgcctgaaccgttcgcttcaatatgagtaatgtcttccggctgttttccgcttttttcaagagccgtcttcatgacggatttttgcgcttccagactcggcgtagccgggcctgccgttcttccgtcattattgacggatgccgccttcactacggcataaatagaatctccgtctgcaatggcctgagacacggtttttaaaagaaccattccgacaccctcgcccagcacgactccatcggcgcgttcgtcaaatacatggaacgactgcgctttacttaatatgccgcgctgttcaaataatttatgggtttcttctgattcaaacaggctcacgccgccgacgacggccgcttttatttctcctgttacaagagcctgcacggccatattcattccgactaaagcagaagaacaagccgtatcgagtacaacactcgggccgcgcatatcaaaatattgagagagattggcggccaaataattctggcccagcgcgacgatcgggtttttcgcatccagcagtttctcttcacccggtctgtgacggctgcgtccgccgaggtacacacctattgcttctccctttatctcatccggcgtatagcccgcgtgataccacaggttaagacattcttccagagcggccaaagcttgagggtccattgcctttacatcttcttcagccagtaaaaagaagtccggatcaaattgatgaattccatcaagcattcccgcgtaataaggcgtcttcaacccccatcgctcagccggaacaggaccgatagccgaacggccttcagccaaaagcgaccagtacgcctctaaggaagccgcccccggaaaccggcaggacatgccgacgaccgcgatatcttcccggtgaatctgtttttcggccgcctcttcttgcaccttaacggcttgtgttacaattaccggctcagccggcttcttcataacaggctcagccgccgccaaatcaaaccgttctgacaaaacttctgtatatccttcgagaagccattttgcgaaagattgaatcgtcggatattcatacagaatggacgggtcaagcgatgccgagagattccgattgatccgctgcagaagctgagcaaggataatggagtccactccgtaatcttggaataatacgtctgtctcaagctgatcctggtcaatccgcagctcttcagaaaataattctttcagccattcttctgttttccttgttaattgagcgttgtctgcggcggtatcagcggttttttcagccgattttaccatagccgggctcattggctgatcctgcctgctccgccgcaggaatcgctccggcttccacagcttaggattcagaacggccggcagcaccgggccccttgctgattcaagaagtatgccgtcaaggagctgtaatccttctgcattcgtgatgctgtatagcccgctctctttataagctttgttcgttacttcgcccattccggtttctttccagttcggccactgaatgcttacgatcggcagctgctctttgtatgagtctgcaaaatagtccatatacgcattggccatggcatagtcggcctgtcctgccgaaagcgccggtatcgcagctgacacagaagagaacaagacgaaaaacttcagcggctcttcgctgagcacactgtataacgcctgaagcccctctactttcggctcgagcacgcgctgtatgtcttcatcggtttttctgatgaatgcgagcgtctctttatcggtcacacccgcgcagtgaatcacgccgccgataggtccgagcgtctgtttgatctgactcaattcctgtctcagcccggcttcatcagctaacgggactgacaataccttcacttgtacacctttggactccaagtcgagaacagcttcaattttcgcttttacagaagccgtcaccccattcagtccgcccgtccactcacttcgcggcggaagggtctcacggcctgtaagcaccagttttttcactccgtaatgttcggcaaaatggcgtgcgcataaaaggccgatccccctcgtccccccggtgatcagaagcacatggttatccggaaaatcaattctgtcgccttgcatattcatattttctgagccgctcaatacggcgcggtagcgcaagccgtccctccggcaaacttccgcgtcatcagtacgggcatgaaactcatcggcaatctgcttcgccagtttgtcatccgaaagcgctccttcaaggtcgagatgccttgaagacagatgactgtactcgcatgccagcattctgtacagcccggcccgttttgctcccgttatttgattggcctttttccccattgactcaaggtctttcgtgacacaaagcagtgttatcccttctttatgcccatgctcaatcaattgctgaagccatttgataccgggcatatctccagaagcttcttctttcgctgcgccgagaaggtcgatgactccgccaaacgcctgccagtcatattcaccggtaaggtctgatgttgtgataatacggtgattcggcatatgcgctgcgatctcttctgcgagattgatcgtgtccccgcctgtcaaaatcgcaacggaacgtgggcacggttcacgcagttcgagcgggctcggttcccattgttttgtcagaatacgtttcatccgttcctctgtatggaccttatttttgtcaggattctcaggcacccaatacgtgtcttttgcgaacggataagacggaagactgagtaaacgcggcgtacccttttcatacagccggttccaattcaacacgccgcctttcacccatacctctgccagcttggcgaattttccttttttaatccaggcgtcaatgacgatgtccatatcttcatctgccgtgaacaaggcaaacgtatctttattgcggtgagactggccggtatacagcccggcgatgtttttctcatttttcgtaaatgcttccagctttgtttccaattccgccatcgtcgctgcaagaatggccaggcgctcttccatttcgtcccttccggtttgcagcgtataagcgacgcccgccaagtcttgatctgtatacggcgtttgacggatcgctttttgcagctgctgcgcctgttcgaacagtttttcttttgatttggcggacaaaaggatgattgccggattttccgggctgtgctcaggctgcgcggctgctttcgggacatactcttcaatgacgatatgggcgttgaccccgccgatgccaaatgagctgaccccggcccggcgcggaatcgcatttccgtttctatctttcgctgccgtccattcctgattttcccgcacgatgtagaaaggactgtcatcgagctgaatgtacggattgatcatctcgcaatgcaggcttttcaccagcgttttgtgcttcatttgcaaaagcactttcatgacgcctgatactcccgcggcaagctctaaatggccgatattgctcttgaccgaaccgatgccgcagcggtgatcggagacttcaggctcttgatttgttttcgccagctcgtgaaacgccgctttcaaaccgtttatttcaatcgggtcgcccaattccgttcctgtaccgtgcgcttcaatatacgtgacggtgctcgggtccactcccgctttccgatatgctttcaccaataaatcagcctgcagtttcggattcggcgaggttaacgtattcgcccggccgccgtggttttcagccgtaccgcggatcacgccgtaaatcggattgccgtcacgttctgcatctgtcagtttcttcagcatcagaattcccgcgccttctcctctgacatacccgttggcatctttggagaaggttttgcattttccgtctttgctgagcatgcctgctttgctgtagctgatatgcgcttcttccgtcagaatcgtgttgattcccccggcaatcgccatgtcgcattctccgttttctatagcggataccgcccggtgaatcgcaacaagcgagcttgaacatgccgtttcaaccggctcgctcggcccgtgaagatttaacaaatagcttaaacggttcggaccgatggaaggaatcatgctgcctgtcgccgcatgtccttccggcgcaagacctgcccttgtgaacaaatctttataaccggtatttccggtgccgataaagacacccgtatttgtgccggaaaggctttccggcttacagcccgcatcttctatcgcccgccatgcataagtcaataacagccgctgctgcggatctaaatattgggcttcccgcggtgaaatcccaaagaacagcggatcaaattcagctattccgtcgataaagccgccccacttgatattcgttttgttcctttcaaggttcgggtcgccatcaaacgcttgccaatcccagcgttctttcggaatggttgtgatagaatcttttccttctttcagattgcgccaaaattcctctatatccttcgcgcccgggaatcggccgctgattccgacaatggcaacagggtccaagcggcgcggctcttgtgtcgctgccctagcgttcattaccgttgcgaagcgctttttccgctgcattttcggtttttggacttttggctgctcttttttcggagactccttcttcttttcgccgaaacggcccggatgttcttttgccaaatatccggcgagattactgatcgttccgtactcaaagaaaatcgtcggcgccagctccagctgatacgcttcatttaattgattcgtaaagacggtaaaggatacggaatcaaaaccgtattcactcagttccgtatctgtatcaatgtcctcacggtcaacttttaaaatgccgcttaccatggctgtcaaagcggtgtgaagcgcttgaagagattcttctgcatcgtgtttttcttccggctgaaaaggaagacctctctctgtttcatccaacaaatactctgctaaactgcggatcgtcccgtgctcgaagaagatcgtcggtgccagctccagctgatacgcttcatttaattgattcgtaaagacggtaaaggatacggaatcaaaaccgtattcactcagttccgtatcaatatcaatctcgtcttggccgacttttaaaattgaactgaccaatctgataagcgcaccgtgccatttgtctcccgaaacggcggatacaggctctattttctccacctgcggcttttcagtttcagaaacggacaggaacgactgttttaattttgctgcgtgtccttcagctgctaaaagctgcggcttttcctgagccattccttcataaaatgcagccaggcctgacgccttttgaagcggaaccatgccgaaagcttttttcatcattctctccgtctcgtctcccgcctgcataccgccatctttccacagcgtccagttaaaggcgatcgtttttccgtgccgcagaccattctccgtaagggattgcctgtaagcggcgtatgcatccataaacgcgttgccggcggcataatcagcctgcccgacattgccgagaacgccggaaacactggagaacaatacgaaaaagtcaagattgcagtctttgctggcttcatctaaataagcggtgccgatcactttcggatcaagcacttccctgaactcttccttcgttttttgcagcaggaaacggtcttgtatcacgcccgctgcgtgaataattccgttaagctccccgaattccgccgtaatctcttttatcagcgcttcattttcccgccggtctgccgcattcagctttttgtagacgacatttgcgcctgagtcctgaagcatagcaagttcacgctgtttggcttctgccagatttgagcggccggtcagaatgattttcgggtgttttacgcgaccagcgatttcttttgcgaacatcaaccccaggcttcctgcgcctccggtaatcagatatacgccttcgtccttccagacggcgccgccacctgcaggatgcatttcttcccaagccttcacataccgtttttctcctgtataacggatatgtttatcatgcggccgatggctgtcgtttttcagtttttgagcggcagccggcatttcgccgattgattccatctcgatgagctgacagtcaagttttccgtattccagctcggctgtttttaacaaacctgttaaccccgcaaacaattgctggctgccgtctgctgaaataacagtctgaatcagaatgcggccctgccttttttcgctgatgatccgccggatgtgttcggcgattgtctgcgcgtagccttggaagcgttcagcggctgtttctccctcaccttctgcaatcagcagctcggcgtctttcaggccggatgccgcttcatcttttatacggcaggcatcttcacaaagtatgatcaaatgctcatcagcatggacagaagctttctcggatgcggcggcttctttccaaaccggtgcaaacaagaccttttccgagcctgatggccgctgagccgattctgcatcgccttcaagcactctcgtagagaatcctctcaccttcacgcaaagcgctcctgtttcgtcgaacaggtcaatgtcggctttctgcacggaatcaccggtttgatatccttcgctgaagcgtgcatgcgcccgcatagtcggtgtgcatggtttgatgacttcaaggtattccagcgcaaacggcagaatcagcttttgtccggaaaactcctgcataatgcagatcgtcgccgtctgaatagccgaatcaatgatgctcggatgaagcgtaaattgtccgttcgtatgagaaacagaatccggaagctgtatatccgaaagcacttctttctcgccgataaaagcggacttaatgccttggaaggcttttccgtggaacatccccctgctccggccttcccgataaaaggccgccggatcaagaatgtccgctgtgcatctgttttgtatggcagaaaggtcggcctcaggctctcgttcagcctttatgatttcagcccgtccttggctgtgcagcacttcttcatcgtcagcgtttacgctgtaaatgtcatatgagatgatgccgtcctcttcaggaaacagcgcgatatggacttggcgctcttgttcgtgaacgacgatcggtttcatccagacggtatgatggagcgttattctgtcttggtcttttaataagccgccaagcgcccgttttaccgcttcataagacatttccaaatatgccgctcccggcagcaccgctttttccctgaccacatgatccttcaggaaaaattctgagcctgtaaaccgtgagctgaaccgctgaacggccaaatctgacgtattttgctgcacaagcgggtgtaaaactgagactccggtgtgtgcggcagatgttttcttttctgcttttttcggccagtacggctcctttgcaaacgggtagaccggcacgctgatccgtttcggatgcttgtctttgtaaagcttgtgccaattaatggcgacacctttactccacatttcacagagcttcgttccttttcctttcgcaagccatttctcaatgagttcagcgctgtcatcatcatcagaaagccaggcaatatcttttgcctgctgtttttctcctctgaagcagcctgttacagccggcttatcattgataaaatcggcaagctgccgcttgagctccgcagtgccgcttgtgataaaggccgcgcgctcttccatcgcttcccttccgacttggaacgtgtaggcaagatcagcgaggccggcgtccgtttttctttccagaaaagccagcagctgttttgcgtactccttcagacgatctttttttctggcagacaacggaatgatgaacggaccggcagcgtctgctgcttcggatgcatccggatattgttcaaaaatcgcgtgtgtgtttgttccgccaagaccgaaagagcttaaagccatgcggtgcgctctgttctcacgggttaactctttcttttctcccgctacgtaaaacggagagtcttctaaatgaagattcgggttcggctctttgtaattgatgctcggcgcgatttcctgatgatataagctcatgacaaccttgatgcagcccgccattccggccgctgtatccaaatgcccgagatttgttttgactgaaccgatgccgcagtattgttttttatctgtatatcggccgtacaccgattgaagtgcggacagttcgatcgggtcgccgagttttgttcctgtgccgtgagcttcgacgtacgcgatcgtttcaggatggatgccggtctgatcaatgaccttctgaatgacctcagcctgtcctttgacgctcggcgcataaaatccgaccttatccgctccgtcgttattgacgccgattccgcgcagcagcgcataaatatggtcgccgtccttaacggcatccgacgcttttttcaagagcacggcgccggctccttcaccgccgatcattccgtcagcagccgcgtcaaacgctttaatatgcccgtcgcttgaaaaattcagccccggctgatgaacatatccggcacttgattccgtatgaagggtcgcaccgccgacaagggcatacttggcttcgccggactgcaggctttgaaaagccgaatgcaggccgattaacgaagatgagcagttggcatggacaaaatagctcggccctttcaacccgagtttatgagaaatcatcgtcggaatcgtgccgctttgggcaagcacccatgatacgtagccatccggcgtttccagctgtgctgtcgtctcctccggcagcaggctgcggtaagagttcgtgcttgcagacatatacacgcttgtttccggaatttcttttgagatatatcccgcatcctcgattgccttccatgaatggagcaaaagcattctcagctgagggtccatatattccgcatctttcggtgaaaagccgaagaaaccgggatcaaacatttctttcccctctaaaactgatttagccggaacgaagccgggatgatcagccagttcttcagaaacaccggatcggcggagctcctcttttgaaaagaaggtgatgctttctttgccttctttgatgttattccaaaattcataatgatcttttgctcccggaaactcacaggatataccgataaccgcgacactgtcctcataataatcgggaatttctcccgctgggtgttcccggtcttctgtattcactttcttttgcggcacaggagccaaaacggtttctttcagtttttgttctgtgatgtaccggctgatgtcttttaccgtcgcgtattcaaacagctccgttacactgaattcacaattcagttcctgcgtcatccggtcagtgacagccacggcaagaagcgaatctccccccgcatcaaaaaagcggtcatcaagctctatatctttgcttttcaatacatcctgccaaatcgccagcaccgcctgctggatatgagatgatgaaaatgtttgtgtgtccggctgcttttccgtcagatcgcgcgcagcaagaagcttgcggtcaacttttccgttcggtgtgagcggcagctcttcaagacggataaacgaagctggcgtcatataggccggcagcgcttgtttcaaatgattgcgcaattcctttgcagacggaagcggctctccgtttttcaggatataaaatgcgcaaagtttttcatttccggagtgattgttcacaaccaccacgctttcctgtacggccggataggcattcagccggctctcaatatctccgggttcaatccggtagccgcggattttgacttgggtgtccatccgtcccatgtattcaatgcggccgccgggaagaaaacgcgccatatcgcctgttttataaagctttgatcccagttcgagccggtggctgacgaaaactttatctgtcagctcaggcttgttgaaataccctcttgccaatccgtctcccgcaatacaaagttctcccggcaccccttctaaaacagggttgagagcggaatccataatatacacacgggtattggcgatcgggcgcccgatcgtaagcgcgctctcattttccgttatacgctgcaccgcggaccagattgtcgtctctgtcggcccgaacatattccaagcctcacttttcgtatcgagaaactgctgcttcaattgttcgctaagcgcctctccgccgcaaaggattttcactttttcttcatttgaccatccggaatgaaagagcattttccacgtaaacggcgtcgcctgcatgatcgtcggtttgtactcttgaatcagctctttcagcttccgtgcgtcttttgtgacttctgtcttacagatgttgcactccgctcctttgattaaagggaggtaaagctccagtgccgcgatatcaaagcaatatgtcgtgacggcaagcagtttgtcttcggacgtaagccccggttcattcgccatcgagattaagaaattggtcagcgcccggtgcggaatcatcacgcccttcggtttgcccgtgctgcccgacgtgtaaatgacgtacgccagatcgtcaggtgtcactaaccgcttcagcgacgttctttccgcggctgtactttcaatacgagaccaatcgcggtcaatggcagttgtctgcacgcctccccagttcaaggagtgctctaaatcagctgtcgtcagacacattgaaatcctgctgtcggcgatcatatattccaatctgtcagcgggataagaaggatcaagcggcacatacgctcccccggcttttaaaatgccgagaaggccgacagccatatgcaatgaacggtctgtataaatgccgatgagatcatcagggcctgcaccgtgcgcctgcaaatagagcgccagcttcgtgcttttttcatcaagctcacggtacgtcagcttttgctgttcatacacgaccgcacaagcgtccggcgtttctgccgcctgacgttcgaataattcatggaagcaggcatccggatattcactgcttgtctcattccaagtcttaagaatcatgtgctcctctctttttgtcatgagagaaacgttctcaagcggcatatccggattcgccgtcaaagcttcagcggcctgtacaaattggctgaaaagtctggccgcccctgcttcgtcgaataattcggtgctgtatttaatcgtaagatccatgcctgatgcttcttcccacatttcaaatacaagatcatattccccctcctgatgaatgtcttttacaaactcacaggagaattccttgtattcatccagcatcgattgatagcttgaatgctgcagaaagttctgatagaaaaaggcattgctgaaaacaggcgaaccgttctgcaggggtttcgcatgcacatcacgcaccattttcggaaacggataaaaggagtgatccagtccgtccagaacggcatcctgcaccttttgaacaaagtcagcaaatgtttcttttcgtccggctctgctccgtataggaagcatgttgaggaaatggccgaccactccgtcaaagcgttcttcaggtctgaccattgcaggca
